United States Patent 10,233,495 (METHODS AND COMPOSITIONS FOR SCREENING AND TREATING DEVELOPMENTAL DISORDERS) - sequence listing, part 63

SEQ ID NO: 613 - DNA, 28097 bp, Homo sapiens
agtattattactttgttgttatttggctctggtcagatttcaattaacgtcacaataggatttaaacatttcttttattatttttaagattttaggccaggcgcactggttcccagcacgttgggaggccgacgggggtggatcaccagaggtcaggggttggagaccagcgtggccaacacagtgaaaccccttttttactaaaaatacaaaaaaattagctgggcgtggtggcatatgcctgtaaccccagctattcgggaggctgaggccaggagtttgagactagcctggggaaatagtgagaccttgtctctaccaaaacaaaacaaaacaaccaacaacattaggccaggcgtggtggctcacacctgtaatcccagtactttggggggctgaggcgggtggtggattgcctgaggtcaggggtttgagaccagcctgggcaacatagtgaaactctgtctctactaaaatacaaaaattagctgggcatggtggtgggcacctgtaatcccagctacttgggaggctgaggcaggagaatcgcttgaacctgggaggcggaggttgcagtgatccatgatccggccattgcgctccagcctgggtgacgaaagtgaaattccatctcaaaaaaaaaaaaagttagctggatgctggatgtggtggcatgtgcctatagtcagccactcagaaggctgaggtgggaggatcacttgagcctaggagttcaaggctgcagggagccgtgatcataccactgcactccagcctgggcaacacagcagactctgtctcaattaaaaaaaaaaaaagcgcagaagaatattggtttatggagagtattattttaagttttagaaattttctatgcaaaacaaacaatggaaaataagaaatgcattactctataataaaatatagccttttctctcccatatatatatatgagtggataaaaacagtcataacttcctacacatttaatcctctatactaactctcatacccacttaccactccctcaatgacaaacataccaaaaagatgctaaataaatgaaaacaatactttgtattcttaactatgtaaagtattgtacttaacaggtattttcttggctgactggttctccatacccaacaaacacagtgatgtcaactctcaccactcatattaaacaatatagccattgctgtaaagtacaaaagagaaatgcagtacaaattgaaaaggaggaaataaaacttttattcatcgctgatattatcagatacataaaatcccaaggagacaaaagctactactaatgagattagaaggatcccagaaacagacacagacgtgcacacacacctccccacagacacagatacacactcacaacacactcagaagtacattttattttattttgagacagtctcgctgtgtcacccaggctggagtgcagtggctccatctcagctcactgcaacctccgcctcctgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcgctttggcttcacaaagtgctaggattacaggtgtgagccaccacacccagccagaagtatcttttaaacaggatttttaaaagtgggagttgaccctttccaaaatctggagttgggatgggcattagtggtttggagaggaaagagcaggtgtgttgtggctgggaggcgattcctttcagcaccttgggtgatgtctgaggccatacccactttctgtgctatttttgggattatgatgattaacccacactccctttgttcctcccatgtaacctggattcttgggcattcaaccaatattaaacccttcctctgaaaaattcctggattgacaagagcacactggacccatttccattccccatcgtgatcaataggtatcaaaagaaatgatagcttcttagaatagaaatttgcagccactggggaatgtagttcttaaatgtgaatacagaagaatctcttattacaaaattctgtatggctctggatttaagattttgttattttttatttttgagacatggtctctctctgtcactcaggctggagtgtggtggcatgatctcggctcactgcagcctctgcctcccaggctgaagcaatcctcccacctcatcctcccacctcatcctcctgaggagctgggaccataggtgcgcacgaccacacccagctatctttttgtatttttatattttgccaagttgcccaggctagtctcgaacttctgagctcaagcaatctacccaccttggcctctcaaagtgtcgggattacaggtgtgagccactgcagacagccaggatttaagattttaagagatattgaaagccttttgttataataccattgaaaacataaaatacttaaaattaacaaaagttgtgcaatagcataactacaaatcattgatgagagaaattaagtatctaaatgaagagatttatcatggccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtaatcccagcactttgggaggctgaggcgggcagttcaccttaggtcaggagcttgagaccagcctggccaacatggcaaaaccctgtttctactaaaagtacaaaaattagctgggcatggtgttgggcacttgtaatcccagctacttgggaggctgaggcaggagaatcacttgaacccgggaggcagaggttacagtgagccgagttcgtgccactgcactccagcctgggcgacagagcgagactctgtctcaaaaaaaaaaaaaaaaaaaaaattctaggacgtatatcttttacaactactagtcaaagtaattataaaagagtaacaggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagctgggtgtggtggcgggcgcctgtagtcccagctactccggaggctgaggcaggagaatggcgtgaacccgggagacggagcttgcagtgagcggagattgtgccactgcactccagcctgggcgacagagcaagactccatctcaaaaaaaaaaaaaaaaaaaaaaaagagtaacgaattcagagggctcaccttattttacaataaagtagtgtaggcatatactgatcaatgaaacagaaaagaaggtctagaaacagacacttatataatcaactgatttttgattaaggtgccaaagctattcaatgggagaaaggaaagtcttttaacgaaagtgttggaataactgaatttccttaaggaaaaaatatgcttttgctcttatttcacgctatatttaaaaattaactcataatgactcagacttaaaagtaaaagctataactatgaattcttcaaaagaaagcataggagaaaatctttgtgaacttggggtagacaaagatttttaaaatggaaaaatcgatcatagttctttatttggaaattaaaataaaaatgccataagcaatgacacaaaaaatggcatacctagcattacatttggcttacatttagtgtaagatctacacagtaaaacccgctaaacattgctgtgtcatgttgaggaattttttccttccttcccttccttccttcctccctccctctttcttttcttttctcttttctctttctttctttcctttctttctttcttttcttccttcctttctttctttttctttctttcctttctttctttccttcctttctccatctcttcctcctttcctccctccctcccttttattttccttccttccttccttccttctccctctctttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacatgtggcctttgtcttcctgtgcctggcttgtttcacttaatgtaatgtcctccagttgcaactgtgttgtaaatgcaggatctcattcatttttatgactgaatagtactcctttttgtgaattttctttatccattctatccacattttctttatccattcatctgttgatggacagtcaggttatttccaaatcttggctactgtgaatagtgctgcagtaaacataggagtgtggatatatcttggatatactgatgtcttttctttggatatatacggtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttttagtagagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatatttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcaattctcccacctcagcctcccaagtggctgcaactgcaggcgcatgccaccgtgcccggctaatttttgtatttttagtagagatggggtttcaccatgttggccaggctggtctcgaattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgcagaggtttttgtgttgctatatgttttcaactcatttgggttaataccgaagaacatgattgctgtagcacatggtaagaatatgtttagctttgcaagaaaccgccaaattgtctttcaaagtagctgtgtcattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctattgagttttaacagttctttgtgtattttgaatgtaagtcccttatcaggtatgtcccctgcaaatatgttctcctagtctgtagcttgtattgtcattctcttgacaattcttttgcagagcagaagcttctaattttaatgacacagaacttatcaattgcttctttcaaggattgtgcttttggtgttgtatctaataagccatcaccaaacttaaggtcatctagattttctcctacattatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcagaggtttgtggcaattaggtgagcgtgcaatggtttttgaacaaaggtgacacgggggtacgtgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagatggtgacggctggggtggtttgcctttatactgcctgaaaaagagggatggactttggctgattacataattacctcatttcacctcccaactacatgccccaccatgaatcctgcctagcttgggacacagccagcaagggaggataaggggaccccagggcagctgaacagagagggggcctccagactaaatctgtggtacttcaggaggggtgccgcagggctgtggatttaggagggggcaacagataagctgtagaactgaggagtttggaatatttgcataggggagcacttgggctttggatttggggtctgagagtgagaatgcaccccaaagttgtggatctgggggttccaggggagaggaatccaaaggtctgggttttattagggtaagacaaagtgtggctgtgcatttaggggtcttctgttgtggaggatgcagggttaagggtctcaggaagggggattccaggcatatggacttgaaagtctcggggctaggaagacccagggctgtgggtgtggagtttctgggaggaggagtgtgtagcaagcccagcgggttctcccagaaagcccagcagcccagcactgggtccaggggctgacttgattttgcttttgcccagagctgtctcttgatgcccagaatcctcattggaacctcagagtgaggccaggatgggtgccatagaacctccactgcccatctctgattgggaaggggaggaagaccagagccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacattcgagggtgagttaagtctcctttaagaatgattcctgctttgtcaggggctactactattagcaggcagagggaacagtggcagaagagattggggtaaactccagtattaggcacagaggcagatcctggggtgggtgtgagtggagaagggatgagtagccctcctgtccttccctcagggaaattcttccttagtaaacaggacagttaccctttggtgagcatggtcgtatacgggaagattaagtctaggtgtgtatgatctggttgaatctttgtaacaatgaggttggttcatcatgatcatcctcattttgaagatgagcagatctagactccataaatcctcttgagtgaggtcacacagggagtaagtgagggagctgggatgtgaactttctcctcaccccccttcattgactggcctagatcaccctgggagtcaagtgcaggccagccttagcaggaggtgagtgctgggactggcatcagcagtggacacactgatgacattggtgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcgtaagggtggcaccatatagggtctgaggttggtcccagtgggctgtgacatgagcatgaggcaggtgctgatattggtcctatgtgggtctgagatgagcctcagccagaccctgagaggggccccagatggccacaggacaggctgtggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtgggaaggaagattagcaccagcttggcagatatcaatcgctctaatcctgttcaccagtctgcacctgggcctggctcctccttttccttcgtgtttcttaaaaaggtgggagacagaaatctggggagtttgtttctcactggggttggcactaggaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtataagtgttaatgcagatgaggtacatggcagtaagtgctcaatgaatggtagttgttctctttaatctgtaggatgaagcggatggatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcatgcatctttgtgttttgtgccattttgtccagtgggttctcctggatgcctctgccatgtttatcctcatttatacaactgtgtgtgtgtcattctgggtgcatgcttttagtgtctacgtgtatgtatgtttcagcatgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctttgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttgagacagagtcttgctctgtccccacgctggggggcagtggcatggtctcggctggaacctctgcctcccaggtttacaccattcatctgcctcagcctgctgagtggctggggctacaggtgcctgccaccatgcccggctaattttttgtatttttagtagagatggggtttcaccatgttagccaggatggtctcgatctcctgacctcatgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaattttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacacagctcatttttctatttttagtagacacggggttcaccatatttgtcaggctggtttcaaactcctgacctcaggtgatctgcccacttcggcctcccaaagtgctgggattacaggcatgagctaccacgcctggctgtgaatgtaagtttcatgctgttaatcaccactttggactgctaggccccacctgtttttctttatgaaacattagaaaaactgcttgtactcccttgtatttcttcaaatacttccgtgtaaacatgtaacaaaagatttcaaaatgttagaaaaaaaaagtcttttaataggagggagacttgaccttctatagtgtttgcactctttggaaccttaagcaaagacctagttggccagtatagccctcatgccattggcaatgaagcagtgggggagttggggtattagtggttgtggtcagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccaggaaaatggcaggacttagagttcagagatgggacatttagtaaatagtgctacaataaacatgaaagtgcctcaacatactaattttttttttgaggcagagtctcactctgttgcccaggctggagtgcagtggtgcgatctcagctcactgcaacctctgcctctcgggttcaagcaattctcctgcctcagcctcccaagtagctgggactatagacgtgcaccaccatgctgggctaatgtttgtatttttagtagagacagggtttcattatgttggccaggctggtcttgaactcctgaccttaagtgatccgcccatttggcctcgcaaagtgctgggattacaggtgtgaaccactgtgcccggccagctacacactaccagatctcacgagaactcactatcatgagaatggcaagggggacatctgccccctgattcaatcgtctctcaccaggcctctcttccaatattcgggattacaattcaacatgagattggggtagggacacagacccaaactatatcaccttctctgtggtaggttatattgttttatatttttatttttttgagacaaggtcttgcttcatcgccaggctgcagtgcagtggcatgatcatgggtcactgtagccttgacttcctgaggctcaaatgatcctcttatcctcttatctcagtctcccaagaagcatgccaccatgcatagcacattaaaaaatttttcttgtagagagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaattttgtatgtatatgtgtgtgtatatatatatatatacacatatacctgtatattcagtagacacggggttttactatattggccaggctagtcttgaactcctgacctcaactgatatgccggcctcggcctcccaaaatgctgggattacagacatgagccactgcttccagcctaactctgttttataccaaaggtctcactgggctccagtaactacttcctccatttccactctcagggatggggtggcaatggagccccactgttatgggcttccaggatttcccttaatgctgccctcaactttgtaaatagtcctatcattaaactctcaattatcctgtttgtgtatgacttatcattcctgctgggatcctaacccacacagcacttcattgtatggatgaaccatttatttagccagttctttaatgatgaacatttaggtcatttccaatctttcactattaaataaaactgcagtaaataaacttgtatataggtgatttttcacatagtcaaatacaactacaggataaattattatatatggagttgctgaatcaaataatgctgtttaaaaataattttgactgatattgtcaaatcatgtatagaggtgtacagccctattagcagaggataaggatggggacttttcctttggagcaagcccagaatcctgaatgttccaacagctgaagatgaggactgctaagagaactcaaggtaaagaacattagatttctggcaaataggtgtaggtgggtatcttgagtaattcattgaataaatgaagtgtgtaactgtgtttgttccccatcttggaatttttaaaaattattgcttttagatggagtctcactctgtcacccaggctgtagtgcagtggtgagatctcgcctcactgcaacctccacctcccaagttcatgcaattcttgagcctcagcttctccagtaggtgggactacagacacacaccaccacacctggttaatttcttttgtatttttagtagaaacggggttttaccattttggcgaggctggtcccgaactcctgacctcaagtgatctaccagccttggtctccccaggtgctgggattatagatgtgagccaccgtacccagaggatattgttgattataattgttacagaagttttcgaaggtttgtattagaaaatgttaagtctcagaggactgtcttagttcattttgtgttgctataacataataccagagactaggtaatttacacagaaaagagacttatttggcttatgattctggtgactggaaagtccagagcataatgccagtgtctgcttggcttctgtgatggctttcatgctgtatcataacatggcatgaggtcgaaggggaagtagacatttgtgaagggtcaacacatgagcggtgtcctcaatttataacagtctgcccttgaaggaatgaatccattcccatgagaacgaatcctgttttgcaaaatgagacctcactcactaccttgagaaaggcaacaagccacccacgagggtggagctcatgtgacctatgtgcctcccatcaggcctcacctcttaaaggtttcacctcccagcattaccgaaccgggaattcaggggttccagcatgaattttgacaggaacactcaaactatagcagaaactatgaccctacagatagtgattgtaatatttcaagtctttggtatagagactgtaatttccaagatttcatgaatctttctttcatacatggaaggctgggtaagtcaaagattttcaaagattttcagcctcctcccaagagacagtacccatgcatggttagggtctgaatgagcaattgttattcaattgtttgttatgaaatatgacatgtggcttttgggtttcttgctactctcttatgcctcccctcagtcagtgggaagcagcccaaactggaattgaagctgtcaacacaaacctgaaaatgttcagaacttgataactatagtataattataaatcgcacagggccctggtagttaaatcacttcacacttgactttatttgcctgtctgtagaataaagagcaggaaagagtcaaacaagatatggtttgagtcagagcactgatactttttgtagctgtgtaactgtggggaggtcagtcaatgcctctcagaatgaatttcctcacctgcaaaataataataataatgacaataataataatgatagaaatgtactactttgatgcactgatgtattacagaaagaaaaaaaggcaaattttgtctttaaactctcagtttaaatcagtaaactagataccttttttttttttttttgagacaacatgtccctctattgcccaggccagagtgcaatggcatgatcataactcaatgcagccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggcctcccaaagtgcttggattacagctgcaagtcaccgtgcctggctgaactagagtgcttctatctaatcctataggaatcccttatttcttattgctgcaggatgaaaattaaacacagattttaattgtgtggattgaagaattatatcagaagttgaaatcacatcctcaccaagtcttatatgtgaaagttagggcattggttgggaaggagaggaaccctgatacttcgaatggggatatctgggtagcctcagatgaaactgagtcactctgagcatcctttctgaatgaatgtatcttcccctctcatggtcgaggacactagttttctctttcttataataacaggggagttatcttgaaatgggcagtatattctcctcaatactcaccttgtttatttatttatttatttatttttgaggtggagtctctgtcacctaggctggagtgcagtggtgcaatttcagctcactgcaacctccctcccaggttcaagcgattctcctgcttcagcctccgagtagctgggattacaggtacctgacaccatgcccagataatttttgtatttttagtagagacagggtttcaccatgttggccaagcttgtctcgaactcctgacctcaagtgatctgcctatttcagcctcccaaagtgctgggattacagatgtgagccaacatgcccaacctcaccccatttattattttctgtctacagatccctaattagagtcagatcgcagcatattttgggtgacaagtacaagtatgatcttggagataatagcatatactccaaaataattgcaatgcttcttgtattttgcataggctgaaaccaaagttaatagaaatggtaatataggctgagcacagtggctcatgcctgtaatcctagcgctttgggagaccaaggcgggaggttcacctgaggtcaggagtttgagaccagcctggctaatatggtgaaacctcgtctctactaaaaatacaaaaattagctggacgtagtggcacgtgcctgtaatctcagctaccagggaggctgaggcaggagaattgctggaacctgggcggtggaggctgcagtgagccgaaatcccaccactgcattccaacctgggcaacagactaagactccatctcaaaaacaaaaacaaacaaacaaaaaaagaaatgataatatattataagggtgttagatcaaggagaatagaatataatattagattgggctgaatttgtagatcgtggtatacttaaccagaaattctggattgagtatgttagctcaggcagctttaaatggctctaagaattgagataggtgttgagagaaacttggtctcaagagtgactttaaagtcaatgaacttgagatgccacaacttcatcagcattgttcagaggaaggaatccagaagtttggagagataggaatgttggagtgggtttattgtgtgcaaccctctctgtattgcctcacccactagatcttctatgagtgctcatcatctctcttcatgaaggtcatgaagagaggtctacattaagaacttttgggcttggccaatggaaggttgagagaagagcaaggtcagattatcgtgcctggccatgtgataacagtggttgtattcctctgccagaaaccatgtcctcctgctggaggctctcttttacccctatacagtcagtctcagtttcagaaacttgtccctctcactgcacctttccacctagggatgatgatggcttatccttactgtaagccatagagtgcttcaacatcttgtaggtttccttcacactgccctcaactttgtaaaaagtccctccattggccaggcacagtggttcacacctgtaatcccagcactttgggaggccgaggcgggtggatcatgaggtcaggagatcgaggccattcttgctaacacggtgaaaccctgtctgtactaaaaatacaaaaaactagcctggtgtggtggtgggcacctgtagctccagctacttggtaggctgaggcaggagaatggcatgaacccgggaggcagagcttgcagggagccgagatcgcaccactaaactccagcctgggtgacagagcaagactccatcacaaaaaaaaaaaaaagaaagaaaaaaaaagaaaaaaaaacccctctattaagcactcatattttcctgctgggattctgatgcacaaagtctatcaaatgaatgcatcataatttgtttaaccaatatcttggtgcacattttggtttcccgttttccattatgtaaacagttctttgatgaatctagatgattttgcacactgtcatgtacatcgtaggagacattactagaagtggagttaactgagtccaagagtatgttcttttgtaatttagacaaaagcgttcacattactctcctctgaagctgtaccaatttacagttccaagaaccgtaactgagagtaaggattgctctgggaggctgaggcaggagtggataccagcctgggccacatagcgagacaccacctctacaaaaatatttaaaattttttctactactagggtgtagtaccctagtactgcctgtggtcccagctgcttaggaggctgaggtgggaggattgcctgagccagggggtcaaggctacagtgaattatgattgcaccactgcattccagcctgggtgacagagcaagacattgtctcaaaaaaaacaaaaaaacccaccccaaacaaccaacaaaacaagaggccatgttttcacacccagtgatcttaatagctcaagttttgctttagagactgtggttt

SEQ ID NO: 614 - DNA, 35227 bp, Homo sapiens
gcttagtggaacactttctcaggagactaaatattgtattttaagtgaattgctttcatgaaatttgccagaaaatgtgtttcccatgtgaattggtgaaaaaaaatcgacttgtatacatgcagaaatcagaagagtcaaggagaagaaaaccacaaatcctcttctccccaccacatcacctccctgccctcatgagcagcatctgcggaaatttcatggaataagatcaagggcaaaagtgtttgagaagagtaatggtgaaacctgtgatctctagagtcaaagtgcctgagttcaaatcgtagctctaccagttaccaatgagtaacctaggagcactttgtgcttctgtttccttatttgtgagggagggtgaacttggatataatggttacctgatgtcagaaatgtaagtgatttcctacagtatctggcacacggtgggtattcaaaaattgtaaagtgattacttggcagatttcctgaggattggaggcttcaatggatattagatgatgatatggttatggatatggatatgaatataactatagatatagataatataggcagggttctctgttacttttatctccttctttcttcctcaaccctaccattaatggaagagagaactcaaagagaggaatgcgcaaaagttctgttttgaggaaaagtgcattttactaagaagtctgcttacctgttgctttgcttaacagattgggggattttcaggggtaaatgactgaagtagaaaggagggagaatgactgggcaacagagaaaatcaaacatctctttaatgtgtttttcctgtagactaaaaaatgagttgaagactgtagtaagggaagtcttactactactactactactactactactactactactactactactgctgctgctgctgctgtgtgtttccacatggtcaagtaagatttatcccaggaattcaaggatggtacaacattcataaatctctaaatgtggtacagtgtttcaacagaaagagggacaaaaaccatatgaccttacaacacaggcaaagaaagcatttgacaatatttaacattttttaatcataaaagctctcaagaaattagataccaaataaatgttcctcaacacaataagggccatacaggacatatccatagctaacatcatacccaatggtgaaaagttgtcaccttttactctaagatcaggaacaagacaatgatgcccactctcaagttttctattcaacatatagtatcagaagttctatccagaataattgcacaaaagaagtaaataaaaggcattcaaatcacaaaggaagaagataaattttccctgtttgcatatgacactatcttatatggagaaaatcttaaaaatctctaaaaacttttagaatcaacaaacaaataggccacagatataagatataaaattaattggtaaaaatcagtagtttcatacacttatagcaaattagtgggaaaagaaatcagtaaaacaattttacttacaattgctaccaaaaaaggtaaagcagctaggaataaacttaatcaaggagctgaaatacctacacactgaaaactataaaacttggatgaaaaaaatagaaaacaaataacagaaagatacctatgtttgtggattggagaattactattgtaaaatgtacatactacccaaagagatctacagattcaattcaatgtcagtaaaatttcaatgaaattccacagaaatggacaaaacaatccttaagttcatattagccatagaaaaccatgaatagctaaggcaagctttagcaaaaagaacaaagctggaggtatcacactgcttgatttaaaaatcttctacagtgccacagtaatcaaaacagcatggcactggcacaaaaagagacacatagaccaatggatcagaccagagagcccagcaataaactcacacatttgcactcaattgacctttgacaaaagggtcaagaagacacaatggggaaatgtcagtctcttgaaaaaggggtgttgggaaacctgaatatccatgtgtagagaaatgaaattagacctctgtctcataccacatacaaaaatcaactccaaatgtattaaagacttaaatgtaagatctgaaactgtaaaagtactagaagaaaagttccatgacattggtccgggcaatgaatttttggatatgagccccaaagcacaggcaacaaaagcagaaataaataaatggcactacaacaaactaaaaagtttctacacagccaaggaaacaatcaacagagtgaagagacagcctacaaaatgggagaagatattttcaaaccatacatctgatgaagagttaatatgcaaaatatataaggaagtcaaacaactcactcataagaaaacaacccaagtaaaatatgagccaaatagccatttctcaaaagaagacatcaaaatggccagtcaacatataaataatatccaacctcatcattcttaagataaatgcaaattaaaaccacagtgagctatcatctcacgcttgttagaataactattatcaaaaagatgataatgactatcatcaaaaagatgttggagagtatgtggagaacaggaaaccctgttcccacacagttggtgggaatgtaaattaggccatccattagcgaaaacagtatggagtgtcctcaaaattcaaaaatagaattatcatatgatccagcaatctcactactgagcgtatatccaaaggaaatgacatcagcgtgtcacagagatatccgcacccccatgtccattgcagcattatttacaatagccaagatatggaatcaacctaggtgcgtatcaacagataaatggataaagaaaatgtggtgtatacatacacaatggaattctaatcagttgtacaaaagaaggaaatcctgtcatttgcaacaatatgaattaaccaagatggtattatgctaagtgaaacaagccaggcacagaaagacaaacaccgcatgatctctctcatatgtggaatctaaaaaagttgaactcaaagaactagagtagaatgacggtttccagggctagacaaggggtgcagttcggtaagtattagtcaaaggacacaaaatttttgtttagatgggagaaattagctccagatatctattgtacaatatggagtctatagttaataagatgatttatatccttcaaaattgcgaagtgcatagattttaggagttctcgccatacaaaattgtcaatatgtaagattatgcatatgttaattagctgaagttagtcattcagaaatgtacacatatgtcataatatgttgtacatgagaagtatactgttctcaaattagaagtattttcttaagctttaattgaaattaaagttggagaaactgataaaaaatgaaatctcatgtgtgtgcgtgtacacacttacactcacttatatgcacacatgcagggatctctaatccccaggttgtggttgggtacaggtccgtggcctgttatgaactgggccgcacagccggaggtgagcagccagtgagtgagcgttatcgcctgagttctgcctcctgtcagatcagtggcagcattagattctcataggagtgccaaccctattgtgaactgtgcatgcgagggatctaggttgtgtgctccttatgagaatctaactaatgcctgatgatctgaggtggaacagtttcatcctgaaaccaacctccccacccacccactctgggtccttggaaaaattatcttccatgaaaccagtcccaggtgccaaaaagattggggaccactgcacacgtgtgtgtgcgtgtgtgtgtacacattcacaaatatatataaaactgtgacctataatatttgtcacatagaaatcatccaacagattaacaaaactttcggaatacaaacatataccagggttttaactctgttgctgactggtgtaatgggtgatgattaatcctgtgtctgctttcctgcattttctagtatttctgcaggtagcataagaaggctaaaagtaggaactctgaagctggtcgacctggacttgaatcccatctgctccactgattgaggtagggaacgatagacaagttcctctctcagcctgcctccccatttgcaaatagggaatatgagttgtagctttcacacagggatgttgtgaggattagtggagttaaaacacacagaatgctaagaacagtttttgcgttataggaagatctcaattgctgaactattactgctgtcatttgaatacagtgtatggtaagaaaaatgatttggaaagtgaaatttctgccctctaggacttgtgaggtggcatcacagcagggcccagtggggagctgagaggctgctgtgcccagcgctgtgaccctggtgtcagctccatggcctgagtaaggagtgaggacaggaagcctatctgggagctgggagcaaagactttccaacctgcccctcctgaggaagggaaaataaattctccatggcaaagtcaagagacccaagggagattatggtacctgttatgggctgaatgtgtcccctaaaaggcatgtgttgaagctccaaccctagcaacacagaatgtgactgtatttggagacagagtttttaagaagcaattcagttaaatgagttcattggggtgggccttaatccaatacgattgatggtctcataagaagaggagatgaggacacagacacacacacagagggaagaccatgggttgagacacagggtggagactgtcttctacaagccaaggataaagacctcagtagaaattaaccctgctgacactttgatcttggacttcggcttccataactgcaaggaagtaaatgtctagtttcagccacccagtctgtggttctttactatggaagccctaggaaatgaatataggccccaataagcagcaaatgcagaacttgttaaagaggaagaggtgaccaaaaaaatgggtgttaagactcaagtcacaggggagggaggatcatgggggaacacaggacaaaataaggagcacccttagggaggacggtggctgaacatccctgggaaacactgcacccctgtccaactcaagcaggcaccatttcagacttcacttcctctgggtattgaatacagaaggctgggcctggagccacacagccctctcaggctgtctctgagctcactctgtccttgggtaggttgtttagccccagagtctcaagactggtaaggatttaaatagtgattgttctgtgttagtcaaatgaaatagatcaaaatgtaagtaattgtggtggtgagtcaatcatcctgtgacttgatgcctctggtagccagctgctgatccacagagaaagtgctcagctccatgatgtcctgctcttaggccccatctctggccttccttggcagcacttgtggttgtctggaatccccaaaggtccagggacaggatatagccctgccagcggagagaaagggttctagcccaaggcaatgcttacctgtgagtcccagcaatagagtcagcagcaggaaaggacaaggagggtggggccaggaggctgggacaggcatcctggagacctcaggagcctgctctgttcaaacgtctgtggtggggagatgtcaggctctgctctgaggagagaagacaagccctgcctccctcagttcaagaggaagtggctatgatggattgcgacagcaacttgcttctagattgtaacttagaaatcaggcacagcaggcagctacaaagcacagagttactcatactccattttcaggagaatcagacaggctgagcaaaaataatgcttcctcttcaactgaggcctgtgttctgtccacgtggcccccttccccatcttcaggtcttcttgatgatttgccagttgagggtcttgggccaagaaggtctgtggttgtgagttgtgtcctaaactcttcatctcaggaccctaggatgtggttggcttgttgcttcgttctgcaccagcctcaaccaagtgctactcagcagggggcaacaggagggatcgcaggagcctcttgatgttggagaggaaacaggtatgctcttgaaatgattccttattcaaaccttttaatgatataactggcaaaacgtagctcaaattcagtctgatctgaactttggtactttcatgggcctgaatccagcagaagaaatcatttcccaacttcttccaggagagggagtagttttagtttagtaaggatctgttttgtcgggtgaagtgaggatcatgggttatggaaaagggatagggttatgattcgggcagaatgtggcggacaggttcctgaggtcatcacatcaactttaatatcctttgttctgcacagaggacctacttcattcaccactgtgttcagatgggaaatgaggagagaggaagtatatatgccctgaccaacaaggtgtgctaaggagttggggaaatcattgcagccatctacgctcaattttgttctctaaactgggggttataagtatttcattgcagtgttttagtggagattaaaggagataatgattgtaccatgcctgaaacccagtaggtcattattgatgctaatgacaccaggtgaagagcgggaactcgagtggtgcttttgaatgaatccctactacatggtgaattgcccaccagtggctttctcccagcaacccaggcctcctgagacccagattatatgatgtgcttggactacccctgccactctgagatcaattgctttctcttgaattctctgcatcctgctccttataatccacaaattaatttgttctctcacaatttccagctgtgtgactttcaagaagacacttgacttctctgagccttattttgatggtatgtaaatggaagttataacatgcaccaacatgcaccttgtagagatggggtaggaataatataaaccataatgaatgcttgactcataattaattttaaccaaaaaatgtggctataatttttttttatgagaagggctcactgctttcctgccacagttgtgctttagaaaaaccaccttgttaggagaaatgtttgtatcatctatgacttagaaaggcctgtctggaagcttccctgtcacatgctaggttttaggtccttcatctgttattgtcaaatgaaatgtaaaggttatcatattctcattcaaagttctgttcaatgtggcaaatgtgcacagggtgaaatcttcccctcctactccacacccacaaaaatgaaaatgaaaaaggataaaattatattattccgtgtcaaattacacttaaaaacaagacaatagtctttatgtgacatgaaggaatagcagcagttatcatttattgcagaagtcctgtgccccagatatggtgtcaagcattttatgtcagttacctcattaattcatcactctgactctatcaagtaagcactgctattaacctacctccttttacaggcgaggaaacctgaggcacacagagagtaatggatttgctcaagatcactaagcttttagaactagagcataggttgccacacaccacagacttcacttttaatgtttgcactatgacatctgtcattggaaaggagagacatccctcaggaggaagcagagaagaagccatagcctcagttaggaacagcccgcacagtgaggctgtggcaggtgccatgctccaggaggccctgataactccatcacgtggggtggggctttatttctggaaagatggcagtgcaggaaggaatcactgaagatgtggggaacagcagcaccatgagagatagctaaccaattcaagaaaaacaataactcaaaaacaagaacagcaatcaagaggacttcacaactgagaaaatatgaaaaaataaaatataaaaaggtctttaaaattagcatacacagtaaccttataaagatagcaaaagggaagtgaatccataaaataacatcaggcatgtgtgaaacaggaatagtcaggcatgaagtaacaggtatcttggaaaaataaccaaaaaaagagactttggaaatgaaaacataattactgaggacagttttaaaaaatgtaataggttgactaggggactatatatatataagtagtaagttattgggttgggggatcatgtggggaaatcccttaggattcagcacagagacacacctaaacagagtaaggtaaataggtgtaaatataggaataacaaaagatatctcacaaaacatgtcaaaaaatttcccagaaacagctgaggagctgagcacttgcagagagggtggtggtgcccagggttggctctgaaggcacagtgatgatgatactgaagatatttcactgtttgatttagaagggagggcagacaactaatagaccaaagaaatttaaactcagagatccagtggcctcacttttcctttaattatttcaagtcagtgcaatcgccacctattttctctatgaaccgcccagcagttgctttcttgcctgtgtggcctgtgtggtgacaatgatctcgttgtcaggtggcttttgggcagtgaagaatgtcaccggtagagtaatgattggactatgttggtggaatcacattgatgacaatggaaagggccattgggcatttgagtcctgggagacatcctcttaagagagtaaaactgtcttagaggctgaaagaagaatcttctggttgggactaatggcctgtccagtgctgtgagtgatatgtgcttttagtgcctgatttgatttggctctgtgtccccacccaaatctcatctcaaattacaatccccatgtgtcaagggagtgacctggtgggaggtgattggatcacatgggtggttcctgcatgctgttctcatgatagtgagtgagttatcaagatctgatggtttaaaagcgtttggcagttcccgccttgctctttctctctcctgctgccatgtaagacattccttgtttccccttcaccttctgccatgattgtaagtttcctcaggcctccccagccatgcagaactgtgagtcaattacacctcttttatttataaattacccagtctcaggcagttttgtttgtttgtttgtttgtttgtttgtttttgacacggagtctcactctgtcacccaggctggagtgcaatggcatgatctcggctcactgcaacctctgcctcctgggttcaagcgattctcccacctcagcctcctgagtagctgggattacaggcacccaccatcatgcccagctaatttttgtattttagtagagctggggtttcaccatgttggccaggctggtcttgaactcctgacctcaggtgatccgcccgcctcagcctctcaaagttctggaattacaagcatgagccattgcgcccggcctcaggtagttctttatagtagtatgagaatggactaatacagtgccctcttctccttcagagtaaagtggttgaacgctagacatgatcagacttctcaaatagagggagaaaatttatgtgttttacgatgttggggggcaacctaagagattcttgactctgaaccttttagatctcagtttatgttgcaacagaaagtgttggcttttttccccccacttaataactttatttaaaacaaacaaaagtagttttcatattaagtttttattttctctccagcacttggggctagaaagtgtgttgtcactacaaacgtccaaatttatttaatggtatacagaggtatgcacaaggtcatgtaatatcagtatatcccaaattaaccaaagtgtgtttattgatatatgtaatgaaggcctttgctatttgatccatagaacatagtatgttcttagtctatttcaaagctctatgtgtttacatattatttctgtagattattttcagaagcaagttttgtttccacagtatgagtgagcacgttggctaatgtgtaagttagaaataattgataatttttaatatgtacttcatggtaaaatttcttagacatacataaatgagtaaaaacgaaatttagggaattggtattagtttctaaagttttgtttattttcatttgtaagaagtcatttacttaaggtccaattattataaatgaattatcatagtttatgtttaaggaatacccagaaattgtgctgttctacttattttataagaggatagccagattttactttggagcctcctggagctcttcaatgctctttggcctaatgatatctatcttttattactaaaaacgcattatttttatgttttaatgagaataatcatttacatacttcacataatgggtaaagacattttgttttatgaatctatattttttcttactataatgagaatgttatagattatgcatttgtattaatggcatttcttaaagcagtagatttaattataaactaaagcaacctagaaactactgtaggtatctgtaaattgtgttgtaggtactatagacttagtggagtctcttaatcagattatgttgtgaatacatttgtacattattaaaatatatttcaagatgttttgctgattttaataggtgtctttattggagtgataactttaaaggtacaaaactttatatttgtataagagtctactgtttacgaaggaaaaaggaaaaaaaacccagaaatattaatatctaaagatttataatttaaggtaaaacataccagtggttgaaagaggaatatttccttccatgaaaatagcaattggcttggaaggtgtgagacataaagtttcatgcctccaaaaatcatagtttggaatacaggactccaaaattgatgcaataggccaggtgcggtggctcacacttgtaaccccaacattttgggaggctgaggcaggtggatcacctgaggtcaggagttcaagatcagcctgaccaacatggagaaaccgtggctctactaaaaatacaaaattagccaggtgtggtggcgagtgcctgtaatcccagctactcgggggctgaggcaggagagtcacttgaacccgggaggtggaggttgcagtgagctgagattgcgccattgcactccagcctgggcaacaagagcgaaactccgtctcaaaaaaacaaacaaacaaacaaaaaattattttaactgatgcaatagtgtcaggaagatggcaggatccgtgcttggagcagcaagttgccttcccaaggaaggaactgtcaaggagttctcaaggaactccaatccttcaatgaagatatgctagatgcatagatgcttattcaagtaaaaaatttttgtagaaatcacgtgcagaattcattttcaactttagattgacttggtgcaacatggataaaattggaatatttgaaagaacggggagcctggaagtccatgagctaaaactccccccttcatctaccatatttcgcccccactcacgacattagatgcagatgacgagggaagactttgggacacatgaggaactgggagcccatggatgcctctccagaagactaaagattaggcctgtgggcttaggattaaaacttcctagtctgaaatcaagctctaccagctcccaagtgtgtgaccctggggacactattaacttctctgtttcttgagtttcctcaactgtaaaatggacataataatcacaccaacctcataagattgttatgggaattaaatgaactgatatatgcaaagtgcctaatagtatctgactgtatcctcaaacctagatattcagttttactattattattatacatattagctagacattattgttgttaggtagaattttagtaatagcaacaattttaaaaaacagatcctctgccctcaaggatttatgatgttatgtgacaacctcggccaatgtctgggggaggtgggggtaccatggtgatgagctgaggtcatgtgcttagccctagaatcatgggtgctgagatcatgtgctcagcaccaaggtcatggtgcagccatggcctctggggagaatcactatgactagggcaaggtgcatcctaattagggtctacacagatgctcatagaaaaagtgctccaaatcttgcctcatgctgggataggagacaagaaaatgctcccaagtggaaatccagaggaacaggagagatggactgagagggagaggagacatcacatagaaatacacctgtatagagcaggctgcacacaactgtgagtcctatgagcagagaaggtggcagggcctgtccaggtgagctgggacacagggctggggatatctgtctgaatgactctcatgaagagacctcagactctatgctctgcaggggaggagaagccccaccttgccatgatgtcccaggagggaagttgctgtgggaggaaggggccatgagactggggccatcttccattgtgaaagaggaagtggacacagttgccactgctaggaagttgctgacgtctgtgcttggggttcccagacctgggagccttggacagtactggagagaggttgactgacatagagcctgctctatgtcccagagactcttacctcatgccaggggtcccatgacccttcctaatttgagagttcagacctatagggttctgtagccaaggattgagcttgcagcttcagagaccataattccaggtgtggcacatttgagggcttgtggctacagaagcctttgggggtggaaccaaatctcctgggtgacccctacaagaagtctctcaaaccaacaccaactaacaagctgagcaaatcaaaaaacaacaactgctcttagatctgtcggagaaatgaggtcatagggcaaaattagagagacagcagggtgatatggagaattacaacttcctgaattagaaacctccatgggaaagagtgctggggtcagaaaacctgcaccatgaatggtgaattgctataagttcagtgaggaccagtctgagctaaaaactcaggaggacccagtcatgggaactcccacacttctgtgaattttacctacagcagcttgattggtcctcatagtgggtatgagagaaatattcagtagtgcttcctgaagaggaaggagaaaggggaccatttcaaattataccagagtgttctcatcatcttatgcttgttccatatcagaaatatacaagaagacaagcactgttccaactatccttgctatgttttacaaagaaataataatttaatcctcaatgtttctaatcctttgaattaccataaactaaatatttttcccttctgtccacatttgcaactgataatattatattttctaatattttgacaaaaattatgaggaccacagagtagtcattatattcccctttggatgtagagttgctttccagggtttcagtattttcacagtcgtttttgtaatcttgcactaccatgcaaagtgaggactgccctgtatttagtataatatatgtagtaatataatacagtgctaaggagaaaagctaatcaaattaagagacattggaatgctagggtggagaggaaaatggatattttacatagggaggtttacataagttgcctttaataaactgaaggacagaagagtgagccacgcagctgttgcggggaagaagccgaggaatgacaggatttgacttttccaaaaaataactgaggctggaaaaatgcaatccatcagaggctctataagcggtccaggaggagatgatgctagctgggaccatggaggagtggtggaggtgagagatgtgcaggttatgagtacaactcctttgtgtgccggagcaggcttggactggctcaggagaaccaactgttaaattttcaggaattgtgtattctagttgttaaagtgttagaagcttgaaatgggccatgttggggatattcaccccatagaaattgacaaacactacaattcagccttctgttttctttcaaacatttaccatctatctcaccaggggacataagcattttgaagcagaactgaatatgagatataaacaaagaagaaatcaagaaggacttcacagctttagggctgtcacagtatttttaccatgagcaacagagttgggaaggttgcaggatgatagaaaaactagtgtttccatcacagagagaggagggagagatgctttctttctaggtgtgaggagtaggacactgtcttagtccatgtatgttgctataaaagaatacatgaggctgggtaatttataaagagaggtttatttggcttttggttctgcagactgtacaagaagcatggtacttgcatctgctgctgagggcctcagagtgcttctgctcacagtggacagtgaagtggagttggcataacatggggagagaggaagagaaaaagagaagagggagctgctaggcacttttaaacaatcagatcttgtgggtgctaatagaccaagataacaccaagtcattcatgatgaatccatccccatgacccaaacacctcccacctgaccccacctccaacataggggatgaaatttcacattgagatttgtagggaaaaaatatccaaattatatcatacgtataaacaaagaggaaggataatcatttttctccttaaaaccaggatgagtgttaatttgtattcaggaggcaatagagaatctcaacaaggctgggtaattgggtaggcaggaatccagaaggcagaataactcttgagaatctggactgcagtttgtggcttacggagagtccaagacgatggaggagaggtgtcctgatgtgtttagatttggcgtgtttcccacatcctagggaggtgtcatgagtcactccccagagccccatcccatggcctctgctcaggaccatgaatgaagactgctctggagaatcaaggactctgcaaaggagcaacaggagcctgtgggcaggaagatgtcctgggaggggaggtgtttggagctcagtctggggaagcttctcaccagccccttctctcagtcagagccattcaaggaaggaagtaggcaggagagactgggggttccatgtggcaggggaggagggaaggagctgtgggtaacatgtccatatttaatcatctgctcatcatttaagaaacatttcctgggaggctgttgtattcctggtgctggtctccttctgggatgcctgttgcaagtggagaggcagccctgagataggactctgctggctcagccctcctcctgagtcttgatgcctctctcctcattgcttccactcaggcacacagagggtcagaatgggtacagccctaagagctgcccatctgtggtttctcaacatgacttgacagtgaggattcttttgggcccatggagatcagcatcaaataatctagagatggcctgcaagggaccacccactcagtagcccctgatgcatgctcctcttctcacctcctcatgcgaccccttgggtgctgtaaaaacctttaaacaccctggctatagctcacctcctcaagcactcacacacttcctggggttgggagactcttagagtcctgactcttagagaccctgagagtcctgaggatgctgagggagctctgtcaccttctctaaactccactgaccctgatgctgcatgatatgtgggctgggccctcctcctggccctgcccttttggagcagcccttggtcaggcatccatcccccacacttacagtcaggccttctgcttccagtagacatagatgacagagacaccaaccaccagcagcaccttggggcccaggaggaaagctatgagaagtggagcagcagaagccagtgctgggcctggaaatcaggagacaggagaagttaggaaggggctacccaggatgccatcccagaggcccccacttaccccacctgaggctacctgggaccatcaatgctccaaagcttttgaaactgcatcttaccctggctaccctagctccaacccaaggcagaagccagggaaagaggttcctcattcccttaccctgtcccaggctgccaggttgtcctcccggagggacgaagtggagagaatgtgtactcatgcattcatgtgtggcacctgagtccctcacttgatcctcacaagcctgtagggcagggattattattccattctgatggggaaattgaggctcagagaatttagggagggtcacaaggttgctcgcatccaaacttagggaagcccatcattatgtcccttaggatgattcctgagactgcgtccttttgaacaagacaagtccaatttcccagggtcataggaagaattacaaaagggaaagtaggtgtcatgagtataactgagtacccccagtttgctaaaaaacagtttattttctttgttttctttcccctttccccctgctcccagtttcctacttagcccttcagaaatgcaaatataacctttcacctccccctcaccagacattccctgcagggcaagttcttctgtatactccaagacagatctctcctggagagctggcacaccaaagcatacccaccatagaaacttcacctccaggggtagcctccagactttcatccaccaggagggcatatggaaagcatgcccccttggccacgtttgcaacttacttctgctcaggatgacgccacctcaactgtcaggtagctaagtcaccaggctagtagagggacccctgcccttgttcccatccccattaccttataaaagtgtctgctttcttctccaaaggggaagcagcacatttgaaagcaggacacgttgtgtcccttccccaacctagctttggaataaattcacttttttttgtatcagacctcgcgctccttgattggattctacatgcagcaagcaactaacatgctttttggttatatgaagatggcttcagagtgagagagttgcaggctgctctgtttagccccagtggtgagggttgaccccatgttcttgagagctggggaggcccttgaggggctgggcctaatgtactgtggtggatagaaaacaccctggcatgactgtcatgcttgggagggactcagacatcaagctcacatcaaccccagagcaggtgccatctgaaatctctctgttggacacacagtcagatctggggaagcacacatttggattctttgcatttttacaatgagcatttttttgctgttaaaagcaaacaaatgaagatatgtttacttctgttttcatgtacgttttctgggaaataaaatggtgctgatgggtccttaaggaaggaatggagatctcagcatatgtggctggaaggttggaggccggcagttctcagctggggggctctctaggactttgtctcccctgaggagagctgcactctccaagtgcactcctccttctagggggcagcccatagaaagattggctgaattgaaaataggaaggccacgcctctctactcaattagcagaactctaagggactctctcagcccttggcttctctgcagaatcagctgggtctttgtcctgcctgcactgtggctcagcacgtccctctcctacacttctgcctcactccctcaggcatattgaccctgacagcactctagcatgcttcctgaactcctgtatccacctccagttggcctcctagcaaaattgacagtggaaatggtctgaaaagcagactctaaaatgcaagtttggaaactgaccactcatcaagatcagctggcaatgaggaccccagggctggtagtgaatggagctgggcaggccctggcttgcagctatggtgcaattaataaaactttcactgtcagtgaagcgggaaggaaattccttggcatcaggcatttgaaaccggattgggaaatgatagttatgaggactaacgtgtttgatggctgttgctgggcatcaattctttggggaaagacgatgagaagctaagagtaacttatcatgaattaaggctcggtgtaaaaaccagaggacttcttggcagcagtgtagattgttatctcctggagccagagggcagaaagaatagaagattgggttccagaacattataagagtagcagaaccacagagatggatgaatctcagcttcaatgggctgctatgctgggctagggccctgatggggaagttgtgggaccctgagatgtgggagggaatgtttgggtcaaagcacttacagatcatcagccatcttctgagtttctggggacagttgcagcagcataactaattatctctataactaacctccccaaaccaaaagaagaaacaaaaaaggaaaagtaaattttgcacaaacctgactctgagtatcacttggacaaagaatgccaaactgcaaaatgactgtgggtcaaaagagaaccttcaccacaccctagtgcacaatctcactaggctgccacgctgctggtgcagtatgtcacataaggcatcttgcatgttgtgtaccagcctagacaacctaaaacgcatttcctgccatagcacatgagcaaggatgctacatccagcacactgaaagcacccaaaaatggcagccctggtcggagctctagtgagtggatggaagtctaaaaagcaaattcagcttcagatagatggtgcagattcatctcttccggctcctccttgagaagtacaactaagaactctggaaatatgaggagcaggcataggagaacttccaaggtgaaaaaggaaggcagactggctagggatctgaggactgaggaacagccgtgaggccaggcacctgggacccacccccacaatatgagctcccagccatagaacatgacaaaaaaaatgacacagaaaagagaaaaagtctgtattcaataatataaatccccacttcaagaaactacaagaagtagagcaaaataaacccgaagcaagctgcagataggaattaataaaaaagagaagagagcagaaaattaatgaaattaaaatataaaaaacaatgcaaaaaccaactgaagcagctgatcctttgaaaggatcaataaaatgggaaaaaattatagcaagtctgatgatgaagaaaaaagaaatggcacattttaaatatcaggatgaagcgagggctatcactacagaccctgcagacatcaaaaggatcataagggatattatgaacaactctacacacagaaatatgacgacatagataaaatggaccaaaaactctttgaaaagcacaagttgccagatctcacccaatatgaaatgaataatgtgaatagccctaaactattgaggaaagtgaattcataattttaaagtaccccaaaatattcttgaggtacagatatttcatagaaaaatactaccaaacatttacagataaattaataccaaatctggtgcacagaaaaacgtttacaaaagaaatttggggaaatttgaatgtatgctccattttaggtgatgtgagataattattttaacaattttatgaaatttaatggtataaaattttaaattttatgaagtttataatgatattgtttttgtaaaaaatgtcctctattatcagatcacccaattgcggactcctcttgcaactgcgtgggcgcataactgggtgagcagtggatgtgacgatgcactttccatacatctctgattataggggacattgttgtcctccacttcctgtcttcactcttccagcagacaaatcagcgacccagcactgacccagtagataaagccaacgccgtagagtctgtggctgggccttctaaaagtcttctggaatagacacccctcctggtattatatgagagggaaataagatatattttggtcatagatgggggaacactggccaaattgacatccttgggacgatgcccagcagaaagagacgtttctcaaattagcataaatttgcattataggctggtagtgaccctgtcctcaggacctcagacttaccttaattagtttgggccagtcatctggtctaatgccttgatctaattgtcttcaacaatatcccccattgcttcccaagtcctggtttccccttctgtaaaactccagactcactggatggttgaagcaggaaaggagatcatagatgaacagaaacttgcacataataaatctgcagagagccattgtgattattattggtcaaatatcaccatcgggacccaaaggaggcccttgctttgaccactcatggtcacctgggggcgtggtccaggcttaaactccacatgtctttctgaaattcacacagcagatgcaggagtctgcagggggcaggtcacagatatgaatggaaaagtttaggaaggaacagacaaggcagaggtcagaaggagtaggaaggagacagggtggctgatgagaaacgggaatgtaacaactgtcaggggtaaaaagcaagatgcagaacgtgaggaacacatgatccccttgcctcctttcttcctcattcagcacacatttatgtcaaaaaatctgtcaggttgtacctcaaacttttaatagtgatgactcttggagggtgagatttgggagaatgatgctgactttaaaattctactttatacttatagacttctagcttattttatgacaaacataaataattttaacatgaaagaaaaagataaaatttaaaaatttgaagtaaccttaccaggagcagtatttgagccctgctccttcgggtgggctgagaccttcaggtcatggcttttgctgaccgctggctgcccgtcatgctccacctggcaggtgagcttcacatcatccctgtgggcagatacattcaccaggagccagctcatccagttgtaggtaccatccttgttttctgtaagggttgaggccgtttctgtcctggacacgtttccattctccaaccaggtcagctgtagtctctgggggtagaacttcctcacctggcaggtgacattcacctggttctctgccctcacgggctgttgagtaacctccaaggtgggtggaactgaaacagcacagggcagaagctctgaccttgtggcacagacagatccagggagggctccataacgtagctcccccaccacggtgagggcatcaccaggacagtgctaggcatgcagcaggtgctcagacattgagggtgctctttgcatatgaatgaaattactaagcacaacgcccagcacacagtaggtgctcaaggactggtagctcctactaggctaagaatgagggaaatctataagcaccacccctggcatgcagttggaatgctgtaactgtagcaaaataaagaaaatcaccaagcacatagaggcttagctcatagtaggtactcattaactgtgtttgctatcagtgaaataaatgaaacggctagcacagtccttggcacctggtgggtggtgtggtcacccagccactgccattaaaatgttagtaagtggctggcacatctaggggcatgggaggtgggcagttaggaatttaggttccaggcatttcaagccctggagcaagagtagagctggatgagtggagggtggtggggggtgggcttggtggtcaggtgtgggcttgggctgggtgagggtcctctacctcggatggtctcagacaagttggcagtcccacgaagagggtccccctgcaaggtgacgtgggccacctcgcagatgacttgagagtgaacgtcctcgcgggtcagcaccaccttggctgtgctgtggatgctgtaggacacactgtctcctgcggggtccacgttggtctggaagtctgagagctcattcccatttttgaaccatttcagggtgatgtctctgggtgagaagccgtgggactcgcaggtgaagctcactgtgtgctgaggtgtggccctcgccgcagggcccgataccacgggggcagagggtttggctacaaaaggaccatcgataatcaggagacatgactcagatgacaatcactaacgataagtgtgtgagatgttaagaaccttctgagacattattttttatccttccaataatgtggaaagattaatgagggtggtgtccttattgtcattttacagagcaggatgcaaaggttgggagaggtgaggacccatgtgaggtgagacagtgtaggggcagggcccagagggaagtccaggcctgagttcaaagtcctctccacacagggagacttccaccaatctgggcataggaacaaaattactgattggtctccctccatgttattaactggtcctagctgtcctcccccggaaggctcactaacctcagagagggcatttatagaagccaatacagggatcaatggcaaagtggcaccaccgtgagagctgcaaccaggctgctcagcccaggacaggggtgggctgacacccccagctcctcatccgcaaaacaggaggacggaggacggcgtttctacttcctgggatgtcgccaggattcaatggggcaatggaagcagttttgctctggatcaaacacagaagatgcttccccgaaaaaacacagatctatctttaacccagactttacagatacacagaggtctctctttaggtattataaaaatatgaaacattccgtatttttcttttcacaaatatttcgttctgtcaaataaaaggcattaattaaggataaagctttaacgtagagccaagagtttgtaagagcattggaatcacacctgctagaggtcaagccacaggatgttgcagtagatagacctggataacaactgaagccagggtccgtgggattttgatctctttcacctggagtactttaatgaaataaccaatgagagtgggtttgcagttgaggattttcaaccagctaatgaactgtttccaaaaacaacctttagtgaaaatcccctataaaaaaccggtcctgtattgccatacgggacactattcagggtttcactgactcagtgtacccaaattgcacctctttatctttcagataaatgctatttcctttggccttcctaacaatcattttgctgttgttgttagttgttctaatctgctggaagtcctaaatttgaaaagaggaaatttttgggaatctgaatcttcagttaggacaggtttgggtgaaaaacaaggatcactgagtactaagaaagccaaaggtggttagctttttcatcgttaattaattacaagagacaaagacccaggccacaccaacagacagaaacctattctgggccttgaaagcaaacacattggagaatcagaacaacgagtgcagtttctccatgtagatgaattttaagggtgtctgcaaattgctaattgttaccttgaaccttctgccgtcctcttagaaagcacatattatacgtttgactttgccaatattaacttgctccctgatatgcgtgaaataatgtgagagcacagtaaggagggtgtcacttgaagatgtcaagtctttgagacaccagcagcatgggtgtccctagaaggctgagaggctgtcttcagttccgattttttgagggcttcttggcagcctgatgctggctgctctctctgtacctctcaacacttcaatcctccctctatttgtcagagggggtcctcatgtgagcccttgtgtagggcgagactctgagaggatccttggtggccaagggccaaaagtagatagaaaccccaccctgggaagatgagtgagggtaagtgcaagggcatagcctggcatgtagtaggtgcttaataaatagcccctgtgactgtaatcatgaggtttggtcattactgcttctggagctgcatagctattctttaggcaacagaacaaagaggcacacaaacaccaaggaaaggctcaaaccctactcaccgcagctgccagaaaaaacccaaatgataaaaggagcagcaaccaccatgtttggcgaactggctttcaagtaagatcacaggggaagctggaagcattttggaagaaggagggaaaagatacctcagtgacatctgggagtgctgagggagggaggcttctggggctgaggagtgaggatttgctgggactccagcacgtgtttagatacaaatgttttcaagacagaaggttccccagccctgaggctgcatctgagccaggctttgtcccagtctcctatcttgggccctgaggccagtagcatgggaggggtcctgttcaggcttctggggcctcccagaatgtttccagaatggctgttttgaagcacccatgacccaaaaagctgttctcaaagccccaaaacctggggcaccgcttttgctagggggctgtgtatgagaatcttctggagccattaagaactttagatatccaggcccaaattagatgcaattaaattggcattttaggggggttcctgggtccagctttgcaaactttttttttgatagttttcccaatgattctaatgagcagccaaggttgaaagccactggactccaacccaaaccccatttatacttggggcctacagaagccctgacctgtctgaggtcacacagcttcaccctaacacaactcacctttattgagcatttactgtgtgcttgttgatgccctaagcattttacacaatatcactccttcagactcggcccagtctgtgaggtcagtgttaccatcaaagggtgaggacatcgaggcctatggtggtgaagcaccttgtcccaggtcacagagccaggaagtggcagagccgggaagaggcccaggcagctgggatactgcctgtgttctcctaacgacagttctgcagaagctcagtaataacctgaatgacaccaccattaggggctctgtgcacatcctctccaatcctcacagaacccagaataggccatgataatcagcatctcaccgatggggaaaccgaggactcaagggaaggcaagactggcccaagatcacacgatcttgaaataacacctcactttgggggtgcctacagtgcgctaggtgatttacagagagaaccttacgcttacgactttcctaaaggagtccatgattgtctctattctacagatgaagatgccgtggctgaacaaaatgaaggcactgtctcccgattctccatgtgtcccagtgggcatttcctgtgtcccaccaagcacttatgtccattaacagagcaagtgttctaacttcttgagctccaacactgactgccacctcaattgtccctttgagattctagacttcatgcaatgttagggagaagcctccctcctgggtgcccaggcctggttaccctgcagccataagcaaaagacagtgggctcctgacagccggaggggagaatctcaactcttgctcacatgggccccaaacactctctaggaaatgcctcatctcctcatccttagtcctcagcaccatgaacgggcagatacgtgctctgctgggctgcaggaggctcgactctgctcattggacgctgctgagtgaagaggaaacaacacaacatgggggaagagtcctaaatgcctcatgtgtgttgagacctgtcctttaggaaccggcttggcatatcatgagacacgcgcagggcctttctgatgggagtgtgaagacaggccctcctacccctacagggttcttgttttgtttttaatgctttttgctgtagaactgaacaatgcaagagtttagaaagagaaggttggagcatttctccactcttgaaaaaccacagttgagtgtcacaaagacaaaggctgtgagtcaggctgcggggttccagccttggctccctgacctgctcccaagtcaggtctcctctctgagcttcagtgtcctcatctttaaaggaggtagcaaatggcttctccctcatagcactggttataaggagactctggcacagttgctgctctctggcccccttccccacctccctcctttctcatgtagctcatcatttaggccgagagcatggcaaagaggagtgagtacttcactaggagtgagcagatctgagtcacacctgagccaccactggctgtgactgcctgggctggggaggcaccacctgggcatttcagtgtctttgccaatattatctgcacaatcaggaaaaagccaccttccttgtctaagttcaagggttgtggggagctgatttcagtcattactgggcaatgtacattttcatatacatacatgtacatgaaagcatcatgttttacgctttacatatacacatttttttaaaaagctgttagtaaagctatgtgtcttctggagattccgttttttgcctttccaaattccagaggctgcccacattcctttctcacagttacatcttcccatcactctaacctcttgcttgcaccctcacaaatccttctctaagaattaatctccttcctccttcttgtaaggacctttcttatgtattgtgtccaccccgatgctagaggcagatgttaaaaccactgtattaaaaatgtttgaagtggggctgggcacggtggcttatgcctgtaatctgagcactctgggaggctaaagtgggtggatcacctgaggttgagagtttgagaccagcctgagcaacaaggagaaaccctgtctctacaaaatacaaaattagccaggcgtggtggcctatgcctgtaatctctgattgctacatcatctaggagggaaatcaggcaatattctcaaatatgaaaacacactatcctgtgacctaggaacgccacttccagtgggtgtctcccgcctgagtagggtgacacatgtacaaggtcatccattgcatgattgctttagtagctaaggttgggaataacttacatatccatcaacagaagactgtaaaataaattttgatatttccatagattggagtatttttcagctgtaaacacactggagcagctctctatgtcctgacgtggaatctcgatatggaatgacagggcttacatttgggagaagttttccaatcacaaacaagctttagtatctgaatgtgaggtgcattcttaacatttgggaaactgatgaaaagagaaatgctggctctctgacacctggctctgtttgaggagcttttatctagcacctatgatgcaccaggctcttctatggagacagcgtctaacgctggggaaggaaggagactgccacgattcagatatggactctggctccaattctgccactaactggccctgtgaccatggacaaggcccctgtcatgtcttggcttcagtctcccatctgtaaagggggttgggctggatggtctgaaggtccttcctgtgctgacattccataattcaggacttaggacgaagctcttgggcctctgggaggaaaccccagataagcattgttgcagccttatatgggaaacccctaagtcacccacttgtgggacctctttcctgaggtgagggacattctgagatgatgcagctctgctcggagcccatggtaactgtgtgactcagtccccaaatcgcagaagggtttcccaaatagacccacagcaaatgccaaacgtattggcatctcctcccaccaggccatcagattcaacagtgaatgtgcctcccagaaatcttgcccgtggggtgtttctgaggatgaaataaagaaaaacacaatttaccctcttcatgagctggacagatttctcctcattagaagggaagagaatgtaagcttggtggggaagagctttgggctgtttcattcactgctgtttgcacagcatctagggcagagcctggcacacagtggggtctcagtgagtgcctgctgcataaagaagagacttggccaccctgagggggaagcgttctctggaggcagaaggcaaggtccagccctgtgcctgggcaagtcactcaaattgtcagttccctcatctgtggaaccaaagggctggatcagctttggaaacacaagagctgtagagccgcaagctggggatgccttctgtcccatcatttccaagccgtggagcctcgagcgactgccatgacatctccaagcctcaactcatgtgatctggagaaggggtgacatcagttcatgaaagggtggctgctcagccaccaccacacctgactgttgctctaagaatggataatgtaattattgagttattgtcacacactaggggatgaaggaagcccacgctgtactcaccacgcacagacagctcggtgcctgctccagacttaaactccacgtggtcggggctccctttccggaacttcacacagtagtaggtgccggcatctgctggggtgatgttactgatgcggatggaaaagtccatgttgtttctctttgtgaggtctgaaacagttgttacccgtgggaagtggccttctttctgattgtagattaattcccggcctggtccagctcctctgaaccactggatgggccccacagggatcagggaagtcacagtgcagtgcagagtggccgactctccagctgcaactgatatggacttgtcaggctgaatcacctgcagctcttcctcgccagctacccctggaaaggagcacaaagcagtcattttttcatccttacgtgatcctctgtgtttcctcaagtgtttatcaatggctttcattgaccgggtgcacaccaggaaaaggccttgagctcagcacactacacgtattatctcatttaaccctcacaactggcctgtgacataagactgtaatacaagcgaggacactgaggcacagagaggttcaatttctgtttccttactttcttttgttctttctgtttgctttttttcttttcttttctttttgtttttctttttcttttttttaagacagggtcttgctctgtctgctgcccaggccggagtgcagtggtacaatcacagctcactctagcctcaacctcccaggctcaagtgatcctttctccttggcctcccaagtagctgggaccacaggtgcgttccaccatacctggccaatttttgtgttttttgtagacacacagtttcaccatgttgcccagactggtgtctacctcttgggctcaagcaatgcatctgccttggccttccaaactgctgggattacagacgtgagccaccatgcctggccaagaggttcaatttcaatgtagagctttgggttgaggacctgagtagaactcttgagccctccttggaagtgccatgttttgctaaatatgtgcctccactctgtggctacatggagtgttgcactttttgcatcaatggattgggtggggccgtgtgacttctttagacccttgagttacgagcagaagtgatgggtataatttgtgggctgtgcatgtaactgcaagagcctctgtggatcaatttctcccttcctgagacccacaaggctctaatggggcctgctccattgcctggatgcgtgaatgaccgttgcatgcagaactgccaatccacactgaatatgtagcttccagtagaaatacaacattgttttaagccccttgtaatatttcacccatagcataaacacattacataagtttcctaatgctgatgtgacaaattaccaaaacttagtgtcttaaaacaaatgtaacattttatagttctgggggttagaagtccaaaatagtgttactggggtacaatgaagaagaaatgaagaacgtcaaatacacaaagatagagaataaaacagtggtgactaggggtgaacttaggggaggtgatggggaggtcaaaaggtataaaattgcagtaagtctgacgaagaagtccagagattgaatgtgcaatctgaggattctagttaataatgttgtattgaattctgtatttttgcttaaaaagcacattttaggtgctgttgacatacaacacatgcagcataactatgggagatgatggatgtgtccatttgcttaactttaataatcatttcactacgtatatgtatatgtgtacgtatatgaaagcatcatgttttacaccttcaatttccacaatttttaaagagctttcagcagagctatgtgtcttctggaggctctgttttttgccttttcaaattctagagttttctcacattcctttctcacagttacatcttcccaccactctaacctcttgcatcttcacatgcaaacatcctggaatacagggatgtttcaacgtcattctccaagaattaatctccttcctccttcttataagcacacttgtgatgtattagctccaccctgatactagacccagatattaaaatcactgccttaaaaatgctgagaggtaaaggaaataacggaccaagaactaaaggaatataaatgtcttaacaaaatgagaatgtaaagaaagagaaattataggaagaaatcaaacagaaacttaggaattgaaagtacaataactaaaagttcactagaggggtcccccagtgggtataagcaggtggaagaataatcagaaaactggaagatggtataattgaaattattgagactgaggtattggtggaaaatagaataaagtatagagcacagaatctaagggaattgtgagacgttatcaaatgtatcaacatacaccttactggagttccagggggaaaaaagagaaagagagaaaggaatagaagattatttgaagacatagtggacaaaaaccttcacagactagataaaatacaggaatctacctattaagacacagaagaaatgcaagttgaactcaaaaataaactcagagacccacactaagacacattataacccaactgttgaaaactaaagtcaaagagagaatccttaaagcagcaagacagaagtgattccttacataaaagagaccctcaataagattttcagctcagctcttatacaaagcactgaaggccagaagatagagggatggtaagttcaaaatgttgaaagaggaaaaatatgtcaatcatgaattctatacctggcaaagtgtccttcaaatacaagggagaaattacgatattctcagataaacaaaagctaacagagttcatgaccattaaaccttgcctacaagaaatgctaaagggagtgcttcaggtggaaatgaaaggatgctacatggcaactcaaagttgtatgaagaaataaagatatccagttatgtgtacatgttttaaaaatcatgcttcaatatcccacaaacaagctgtgagcaccctgcccaggtgaccaggtaaccagtattttaaagctggtccctgccacaattcctcttcttgtcctcctctactgtgacctagtgacattgaaacaccctagtaaaacccatcatggtttttgcttgtgtcctccaccttgactcccagtaaaggcacttgcccagggatcccatctctcttgcctacccatctgcttgattgagcctgctccttgggagctcctcccacatggcttcctgcatggcctgccctacttccttctctaggaactgtgagtatgcctcttcatatgaacttttcatggccatgttagagtgatcctcaaaattcaaccagcaggaatcactctaacattttcaatagtaatggcaatgaggatgggatcattctaaactcaggtggaaagttcctagggaatgcctttgactcatgacttactgatttgctactctgattggctccacaatttgagaaggcttttcaccctgatgactttcttgtgctatgctatgtacagctttgtgttgccttttggagtgctgccatggctctccatcctgaagcgaggatcctgttccaatatcaataatgacatctgcctttcttcaagagcacaagatgatataacattggtaacacctcttcaaagaagattcatgtgatatgcatattaatgtcacataatccagcatcagtaagttttttctggggtgcttgtggcaacatattcttcatttacaaattttacttacaaattaaaatcaacaggccctcctgttagtgtctttaaatgaattaacaaataaaagtatctcttctctgtagagactttggctgtgtctttcatgcctcttggagtctctaaaccactcatgatggccagacattttccccagggcctttgatgcaaatataatgcccctctcagcttttgctatactccattacaacaagaaatttctggttatctattgggctctcctggcttagagtccagatctggggagcatactttcctgtcgtactctttaaccataaattgtcccaaagccagactctgcttatctgaaatggagcccactggaatctaaacttccatgaaaatacaaaactaagatcactgccaggtagagctgcacacctttctgttaacagttggcattattattactcggtttgttgatgcaataatcctcaaccaaacactagctgagttcagcagcatattagaaggaatatacacaatgagcaagtggtatttattcctggaacacaagaatgtttcaatatacaaatgacaaagaatgtaatacaccatatttatagaagaaagagaagaaacacatgattatctcatttgatgcaaaacagcatttgagaaatgtggacatctttttgtgaaaataccatcaataataggaatatatgaaaatttctataagataaaagttatatacacataccttattttattttcccttatcagtggctaatttatgattttatttacctatttatcatgtatattgattactgtcattattatgactttattgaaaaaagaaatcagtaaggtaatcgcatttacaattactaccaaaaaagctaaaatagctagaaacagatttactcaaggacatgaaagacctccacaaaaaaagctataacaccctgatgaaaaataaatagaacaaaaataatggaaagatatccatgcttgtggattagataattacttttgttaaaaatatacatactacccaaagagatctacagattcaattcattattagtaatatttcaatgacattttcctcagaaatggacaaaacaatcctcaagttcacattagtcatagaaaattgtgagtagaaaaggcaatcttgagcaaaaagactggaggcatcacattgcctgatttcaaacttgactaccgtgccatagtaatcaaaacagcatggcactggcataaaaatagacacatagacaaatggatcagaccagagagcccagatataaacgcacacatttacactcaattgacctttgacaaaaatgtcaagcagacacaattgggaaaggtcagtctcttcaaaaagtggcattgggaaacctggatatccatctgtagaggaataaaattagaccttcctctcacatgacacacaaaaatcaattcaaaatgtattaaagacttaagtgtaggatctaaaagtgtaaaagtactggaagaaaagtgccatgacattggtgtgggcaatgaattttcagatatgagtcccaaagcacaggcaacaaaagaaaaatagacaaacggcattacaacaaactaaaaagcttctacacagccaaggaaacaatcaacagagtgaaaagacaaccagcagaatggaagaagatatttgctagccatgcatctaatgaaaagtcaatatacaaaatatataaggaagtgaaacaactcaatattaagaaaacaacccaactaaaatatgggccaaagatcttaaaacccatttctcaaaagaagacattaaaatggccatcagacctataaaaatactcagccttactattcatctggtaaatgcaaattaaaaccacagtgagctatcatctcacacttgttagaatggctactataaaaaagatgataactagttttggagaggatgtggagaaaagggaattcttgcacatagttagtgggaatgtaaattagtagagccattagcaaaaacagtatggaggctcctcaaaaaattaaaaatagaactatcatatgatctggcaatctcactattgggcatacatccaaaggaaatgacataagcatgtcacagagatatctgtgctcccatgtccattgcagcattatttacaatagccaggatattaaattaacctagatgtccatcagcagataaatggagaaaggaaattggtatacacaatggaattctaatcagcctgaccaaagaaggaaatcctatcatttccaacaatataaatgatcctggaagatattatgctaagtaaaataagccaggcacagaaagacaatactgcataatgtctctcatatgtggaattttaaaaagttgaactcatagaagtagatagtagaatattggttaccaggcactaggcagggggtgcatttggagagatattggtcaaaggatacaaaatttcagtttagttaggagaaattagttccacaaatctattgtacaatatggggtctagagttcataacacaattcgtaacctcaaaaattgttgaaagcagattttgagagatctcaccacagaaatgatacatatacaaggtaggtcatatgttaattagctcaaattaggcattctgcaatgtacacatatttcattaatatggtatacatgataagtatatacagttctgtcaaataaaaataaaatattttgttaaaagtttcattgaaattagaaacttggagaaacaatgataaaaaatgaaatctcctgtgtgtgcatgtacacttacttatatgcatacatgcatatacatatgtatacacacatatgtatacacacatttgcaaatatatatacacacacatatatgtatatatacacacacacacatatatatgtatatatagacacacacatatacattcacaaatatatatcaaagtgtgacctattgtgatagtatataagtttgttttgtgtattaaataaaattacaacacacgttaaaatctcattaaaatatctggcccatagaaagtaaaatatgtggcccatagaaagcatccaacacattaataacaaatttagaagta

SEQ ID NO: 615 - DNA, 276415 bp, Homo sapiens
cacataccttattttattttcccttatcagtggctaatttatgattttatttacctatttatcatgtatattgattactgtcattattatgactttattgaaaaaagaaatcagtaaggtaatcgcatttacaattactaccaaaaaagctaaaatagctagaaacagatttactcaaggacatgaaagacctccacaaaaaaagctataacaccctgatgaaaaataaatagaacaaaaataatggaaagatatccatgcttgtggattagataattacttttgttaaaaatatacatactacccaaagagatctacagattcaattcattattagtaatatttcaatgacattttcctcagaaatggacaaaacaatcctcaagttcacattagtcatagaaaattgtgagtagaaaaggcaatcttgagcaaaaagactggaggcatcacattgcctgatttcaaacttgactaccgtgccatagtaatcaaaacagcatggcactggcataaaaatagacacatagacaaatggatcagaccagagagcccagatataaacgcacacatttacactcaattgacctttgacaaaaatgtcaagcagacacaattgggaaaggtcagtctcttcaaaaagtggcattgggaaacctggatatccatctgtagaggaataaaattagaccttcctctcacatgacacacaaaaatcaattcaaaatgtattaaagacttaagtgtaggatctaaaagtgtaaaagtactggaagaaaagtgccatgacattggtgtgggcaatgaattttcagatatgagtcccaaagcacaggcaacaaaagaaaaatagacaaacggcattacaacaaactaaaaagcttctacacagccaaggaaacaatcaacagagtgaaaagacaaccagcagaatggaagaagatatttgctagccatgcatctaatgaaaagtcaatatacaaaatatataaggaagtgaaacaactcaatattaagaaaacaacccaactaaaatatgggccaaagatcttaaaacccatttctcaaaagaagacattaaaatggccatcagacctataaaaatactcagccttactattcatctggtaaatgcaaattaaaaccacagtgagctatcatctcacacttgttagaatggctactataaaaaagatgataactagttttggagaggatgtggagaaaagggaattcttgcacatagttagtgggaatgtaaattagtagagccattagcaaaaacagtatggaggctcctcaaaaaattaaaaatagaactatcatatgatctggcaatctcactattgggcatacatccaaaggaaatgacataagcatgtcacagagatatctgtgctcccatgtccattgcagcattatttacaatagccaggatattaaattaacctagatgtccatcagcagataaatggagaaaggaaattggtatacacaatggaattctaatcagcctgaccaaagaaggaaatcctatcatttccaacaatataaatgatcctggaagatattatgctaagtaaaataagccaggcacagaaagacaatactgcataatgtctctcatatgtggaattttaaaaagttgaactcatagaagtagatagtagaatattggttaccaggcactaggcagggggtgcatttggagagatattggtcaaaggatacaaaatttcagtttagttaggagaaattagttccacaaatctattgtacaatatggggtctagagttcataacacaattcgtaacctcaaaaattgttgaaagcagattttgagagatctcaccacagaaatgatacatatacaaggtaggtcatatgttaattagctcaaattaggcattctgcaatgtacacatatttcattaatatggtatacatgataagtatatacagttctgtcaaataaaaataaaatattttgttaaaagtttcattgaaattagaaacttggagaaacaatgataaaaaatgaaatctcctgtgtgtgcatgtacacttacttatatgcatacatgcatatacatatgtatacacacatatgtatacacacatttgcaaatatatatacacacacatatatgtatatatacacacacacacatatatatgtatatatagacacacacatatacattcacaaatatatatcaaagtgtgacctattgtgatagtatataagtttgttttgtgtattaaataaaattacaacacacgttaaaatctcattaaaatatctggcccatagaaagtaaaatatgtggcccatagaaagcatccaacacattaataacaaatttagaagtacatacatcacagttgtaactctggttgttgctaacaagtgtggtaggcaataattaattctatgtttacttccctgcattttctaatatttctgctagtagcataacacgactaaaagaatgaactttggagccggtcgacctggacttgaatctcagctgctccactgactgaggtaggggacaatgaatggacaagttcctccctctgcctgagtctttgtttggaaataggggataatagttgcagctttcacacagggatgttgtgaggattagtggagctaaaacaggcaaaatgctaataactgtgtctacatggtaggaagagctcaattgttaaactcttactgctgtcatttgggtacagtgtatgtgtgagaaaaataatttgaaaagtgagacccctgccctctagggcctgtgaggtgacatcacagcagggcccagtggggaattgagaggctgctgtgcccagccctgtggttctggggtcagctccatggcctgagaagggatcaggacaggtaacttgtctgggagctgtgagcagggttctcccaggctgcaccaggaaaggccctccaatcctgcctgtcttgggaaggggaaagaaattatccatgggaaatttaagagaaccaaaggaggttgtagtacctgttatgggctgaatgtgtcccacaaaatgcatgtgttgaagctctaatccccagcacctctgaacgttacagtttgggagacagggtctttaagaagtaatttagttaaatgaggtcattggggtgggccttaatacaacaagactgatattctcataagaagaggagatgaggacacagacacacacagaggaagatcatgtgtttaagacacagagagaaaatggccctgtataagccaaggagagagacttcagtagaaactaaccctgctgacaccttgatcttggacttcagcctccttaactgcaaggaagtaaatatctgtagtttcagccacccagcctgcagttctttgttatggaagccctaggaaaggaatataggacccagtaagcagcaaatgtggaacttcttaaagaggaagaggccacagagaaatgggtggtaagaatcaggtcacaggggagggaggagcatgggggaacagaggacaaagtgaggagcacccttagggaggatggtggctgaacactcccaggatacaccacaccactgccctactcaagtgagcactattacagacttcacatcctcagtttggtgaagagagagggctgggcctagagccacataaccctgttagggtgtctctgagcttactctgtggacttgggcatgtcacttggccctagggcctcaggactggtgaggatttagataatgattcttctctgctttttcaattgaaatattatcaaaatgtaagtaattgttgttgtggtggttgaatcgtcctgtggttcaatgcctctggtagccagctgcagatccacagagaaagtgctcagctccctgattttctgctctcagtcaaagcctaatccttggcctttcttggcagcacttgtcattgtccggaatccctgaaagtccagggacaggccatggctcagtgggcaggaaaaaagattttaaccgaaggcagtgctcacctgtgagtctccccagcagtagcgtcatcagcaggaaaggactaggaaggtggggccaggaggctggcacgggcattctggagaccttaggagcctgctctgtccaaacgtctgtgctgggaagatcgcagactctgctctgaggagagaagacaagccctgcctcccttagttcaagaggaagtggctgcgatggagtgaagcagtaacctgcttctggattgtgaaacagaaatcaggaacagcaagcagctacaatgcaagcagttatgcatgccccatttcaggagaatcagacaggcttagcagaaataatgcttccttcccacctgaggtcttaactccttccatgactcctaaccccatctttatgtcttcttggtgatttgccatttggtgctcttaagccaggaaggacctgtggttatgaaatgtttcctaaactttccatctcaagacctcaggatgtggttggcttgtggtctcattctacaacagcctcaaccaagtgctactcagttggggcaggatgagggatcactggacctgctcagtgttggagaggaacaggtctgctcttgaaatggttccctattccgaacttttataaatataaatggcaaaacttagcccaaattcagtctcatgtggccgttagcactttcatatgcctgcacccagcagaaggaattatttcctgacttcttccaggagaggaagtgggcttagggtaataaggatctgctttgtgaggtgaggtggggattatgggttatggaaaggggatatgtttattatgggggagaatatggagggcagattcctggagcagtcacatcgatttcaatactctttgctctgcacatagaacacctattccattcatcactgtcttcagatgggaactgaggagggagggagaataaataccctaagaagatgtgctaaggagttggggaagttactgggcctgcctaggttcagttttgccttctaaccttgggataataagtctcactgccatgttttagtgaacatcaaaagagataatgactatacatccctgagattcagtaggttattattgatactcatggtgccaggtgaagagagggaactcaaatattgcttttaaatggatttctactgcatgctgagtttcccaccagtggccttctcccatgttccccggacttctggaacccagcttttatggtgtacttggtctacctctgacactctgagatcaatttctccctctggatcctcttcaccctgctttttgtcaatctgtagatgaattccttttcttacaatctccagctgtgtgactttcaacaagacacttgacttctctaagccttaacttaattacatgtaaatggaagttataacatgcaccttgtagtgatatggtaagagtaatataagccatacagaaggtttgattcatatttaattataaccaaaaaattgtggctataattacatttgtgtacagggtgagttcactgcttccctgacatacttgtgctttagaaaaatttccttggtaggagaaatggtttctcctccatcatctgtgactaagaaagacctgtctggaaacctctctttcccatgctgggcttgcaatccttcacctatcatgagtaattgtcaaatgaaattgtaaaagtcatcacatttccatgcaaatttctttttcaatgtggcagatgcacagagggtgaaatcatcacctcctgctccacactcacagaaatgaatataaaaatgataaaatcatgttaatcgatgccaaattacactttaaaacaagaaactagtctctatatgacatgaagggtagtagctgctgtgtttactgcagatgtcctgtgctccaggtactgtgccaagcattttgtcagttacctcattaattcatcactctggtcccatgaaattagcactaccattaacctttttttataggtgaggaaacttgaggcacgcaggcaataatacatttgttcaacatcacccagcttttagaactagaacacaggttgtcacactccatggccttcactatgacacctctcataagaagggagagatatctctcaggaaggaagcagagaagaagccataacgtcaattaggcgcagcctccacagcaaggttgggataggtgccatgttccataaagtgctgacagcccatgatcactcagggcattattcctgtaaagattacagtgaaagcagtaatcactaaagatttggggaaaagcgacatcataataaattcaaaaacaataactaaaaaacaaaaacagcaatgaaaataacatcttagaaaataatacctcagaaaataaaaatataaaatgtgaaaatatttttaacattaacatatttagtaaccttatagagataatgaaaagaaagtaaatccataaaacaaagtcacgtgtgaaacaagaataggtaggtgtgcagtaacaacaggtatctgagaaaagtaataaaaagaagaattttgaaaaaatataattagtgctaaattgtttaaaaaacaaataggtggatgtattaatctgttctttctataattgttataatgaaatacctgagactgagactgggtaattgataaagagaagaggtttaattggctgatggtttcagaggctttacaggaagcataatgctggtatcagcttctgggaggtcacaggaaacttacaaaaatggcaaaaggtgaaggggaagtgagcatatttacacgaccagagcaggagggagagagagagtagggaggtgccacacattttaaaaccaccagatctcatgagaactcactcatcatcatgagaacagcaccaagagggaaatctgacccaaagacccagccaacttccaccaggtcctacctccaacactgggggttacaattcaacatgagattttggtggtggcacagatctaaaccttatcattttctcctgcccactttcaaatattatgtccttatcacattgcaaatacaatcataccttcccagaagtcccccaaagtcttaactcatttcagtattaagtcaaaagtccaaagtcttatctgagacaaggcaagtgccttccacctataagcctgtaaaattaaaaataagtcagttacttccaagatacaatggggtataggcattggctttagccatctgaatgggaatactcccatttcaaaagagatacattgcccaaaagaaagggaatacaggcctatgcaatgcaatctgaaacccagcagggcagccattaaagctccaaaattatctcctttgactccatgtctcacatccagggcacactggtggaaggggtgcactcccaaaacctgagcagctccacctctgtgcctttgcaaaattcaaattccacggttcttctcatacttggtgttgaatgcctgcagcttttccccgcacatggtgcaagctgctagtggatctatcaatctttggtctggaggaaggtggccctcttctcacagctccactaggcaatgccccagtgggaattgtgtgggggctccaaccccacatttcccttctgcactgccctagtagaggttcttcatgagggctccggcttctgcctggacatctagacttttccatatatcctctgacatctaggcagaggctcccaatcctcagctcttgtactctgcatacctgcagaattcacaccacatggagccaccagggcttatggctggcaccctctgaagcagcagccgagatatactcgagccccttcgagccaagaccggagctggagtgaatgcggtgcagtgggccgtgtccgaaggccgcacacggcagcaggccctggttctggctctcaaaaccattcttccctcttagacctctgtgcctgtaaagagatggtctctgaaatgcctttgaaggcttttcccagtgttttcaatattagcatttggcttctttttactcatgcaaagttcacagcctgcttgaattcgttgcctgaaaatgggcctttcttttctaccacatgtccaggctgcaaattttccaagcttttatgctctgcttcccttttaaatataagttccagtttcaagtcatctctgtgcttacgcatatgaattaggctgttagaagcagcgaggtaactgcttcttcttttttgtgtgtgatataaagtcttactctgtcacccaggctggagtgcagtggtgcaatcttggcttactgcaacctccatctcccgggttcaagtgagtctcctgcctcagcctgctaaatagctgggactacaggtgtgtgccatgcaccaccacacctggctaattttttttttttttttgtatttttagtagtgatggggtttcaccatattggccagactggtctcaaactcctaacctcgtgatctgcccgcctcggcctcccaaagtgctgggattacagacgtgagccactgtgccccgcctcaggaaatttcttgaatgctttgctgcttagaaatttcttccagcagatactctaaattgtcactcccaagttcaatgtttcacagaaccccagggcaggggcacagtgcctccaagctctttgccaagacttaacaaaaccgatctttgctccagttgccaggaagttcatcatttccatctgagacctcctcagcctggacttcatggtccatattactctcagcattttggtcacaattcaagaaatctctgggaaattcccagctttcgctcatcttcctgtcttctaagccctctacactcattcaacctctgctcattatccagttccaaagccacttccacatttgcaggtaactttatagcaatgccccactcgtcagtatcaattttttgtattagttcattctcacacagctaaaagaaatacctgagactgggtaatttataaagaaaagaggtttaattggctcctggttccacaggctgtataggaagcatgatgcttgcatacacctggcttctgggaggcctcaggaaacttacagtaagggtggaaggcaaagtggatggagacttatctcacatggctggagcatgagggatagagagggtggaggtgttacacacttttaaacaaccagatttcaccagaactcagtcactattacaagaacagcaccaagagggaaacctgcccccacgattcaatcacttcctagcagtccccatctccaacactggggattacaatttgacatgagattttggtggggaaacagatccaaaccgtatcaattgagtagctgactgtacataagtgagtagtaagttagtgagctggctcttcatgcagggacaatctcctagaacccagcaccaagagacacacccaaacaaattaatgacaataggtataaatatagcaatggtaaaagctgtaacacaaaatagtttgaaaatgttgcaatagaaatactatcttaagaagcatagtttaaggtaaaaagcacaaatggttgaaagagaaatgtttccttttatgaaagtaacaactaacctgaaagatgagtcacaaaatattatgcctccaaaaattatgatttgaaatatatgactcaaatattgatagaataatttccatgctctggcagaatctctacttaaagcagcaagatgacttcctgtgaactccaatccttcaatgaagatctattagatgcatagatacaatttgagtgaaaaattttgtggaaatcatgtggagaattgagtttcaaatttaggttgactttgtgcagtacagatacagcctggatgtctgagaaaaccaggagcctggggaaccatgagctaaaattctctttctgccaagtttagccctgcactcatgacagaaggtgcagataatgagataaggctgtgggacaagtgaggagtcagtggatgtttgaggagagcaaagattaagtttgtgggcttaggaatcagaacttctagatttgaatttagttctatcagttctagctgtgtgacccaggggagtctgtttaacatctctgtttcttgagttctctcaaatataaaatggaagtaatcgtatcaacttcagaggtttgttatggtcataaaatggattaatatatgtaaattccttaataattgctgattgtgctccaaaagttagatgttattgttattaggtggtgttttggcaatagtaatacctttaaaaaacagactctctgtcctcgaggatttacgatgcagtgcgacaaccctggccaatggctgggggatgtgcagataccaccacatgatgagtgtgggtcacgtgtctagccctataatcacgaagtcattactagcacctgggtcatggtacaagcatgacctcgggaaatcactgtgactaaagaaaggcaaatcccggtaagagtctgcacagatgctcacggaaagtgtactccaaatcttgtctcctgctgggatgggagagaagaaaatgttcccaaatggaaatccatagatacgggtgagatgggctgagagggtgaggagacttacatataaatacacctgtgtagaacaggctgctctcacctgtgagtcccaatagcataaagaggcaagggttgtccaggtgggctggaagacaggtatggtcattgcctgctctgttgaaagtttatcacggagagaccccagcctctgagctctgcagggaaggagaagccccacctgccatgatatctgaggagggaatttgctgtggaaggaaaaggccacgagactggcatggtctcatagtaaaagaggaagcaggcagagttgccacccctgggaagttgctgatatccaccttggggttcccacgcctgggagccttggacagtagtggagacagtttgactgctctgggcctgctctctgtcccaggggcactcacttcatgccagggttcccttggcccttcctcagttgacagccctgatccacagggccctgtagctaaggactgagtttggattttcagagactgtaattctgggtgtggaaagtttgaggtcttgttactgtagcagcctttaaggatggaaccaaaactcctggatgtcccctgcaaaaagtccctagggccaacatcaagtaacaagctgagcaaataagaaatggcaactcttctcaggtctgtcagagaaatgaggtcacagagcagaccattgtctccaaaactggaagttagacaaaatgatatagagaattacaacttcctgaagccaaaacctccatgggaaccagtgccagggtaggaaaacctgcactgtaattgaagaattgctagaggcttggtgtgggccagtctgaggaacagattccagcaggacccaatcgcagggaactccaacactgttgtgagatttacctccaggagcttgattaggtgctcagagtgaatatgagagaaacattcacttgtgcttcctggggggtgtggaggggaaagcgaatcattctgaactacaccagagcattctttcttcttaccaagcccagctctcaggagaaactattttaccagtgcctaatctgctgggctttgatcagagcctaacctacctggggaaggcaagcacccaactccagccccctctggccatcctgtcccaccataggggaaaaaactgagaggcacttgtgaagtccacaggccaggggcacaggctcacataagactgcaacctcatgtaactggtgatgagcccatgtgacatttttgggaaacaaataattgaaagagagattggacaaccacagtgaaaatgcagtgaataaatgagcagtgaaaatgctggagataaagttcaaattgtatgtcagtggagttatagaagcatgaatagctggtgaggcaacgtagaccctggtagtgtttgaaaaacttcagataggcagcccgcaggacttagagaaggtgaatttaacagatacgggatggggtactgacaaatagggcgaaggtgtccctgaggatgtgacaacagcaaaaatcttcacgtgaaaggaacttttgcagagatttcacgacactgaaagtgcaaatgataaggtgctggaaacaaatccaaacttagagaggaaggtgataaaacacccagatagaaaggatgtttgctccatatccgaagtgtacaagaaggaggtaagcactcttccaactactcttgaaacatttttacaaagaaataaaatactgaaacacttgatgtttccaatgttttgaattacagggtactaataaatattcatttattattttttattgccttctacatttgtaactgacactatgagagtttcctatattttgacaaaaaattgtaaaggtcacaatatgatcattgtttttctgattggatgtggagattgctttcctgggtttccggctgcacagtcattcttgcaatcttgcactgctgtgaaaagcgagggctgcctgtattcgttataatgcttatggtaataaatgctaaataaaaattaatcaagataagagaaattagaatgccagggtagacaggagaattgatattatgtacagggtggtttgccaaaggtgcctttaataaagtgacattgagcagaggcttgaaggagggatgaagggagccatgcagctgtgttggggaagaagcagaggagtgatacaatttgacttttccaaaaatccctgtagctgaaaaatgaaagccaacagaggctacagaagtgttcccggaagagatgatgctggccgggacagggaggggtgatggaggtgagaagtgtgcaggttagggatgtaactcagtgctctcctgcagcaggcttggactggcccctgaaagccaaccgttaagtttcaggaattttgcaatccagttgttaaacttctggtagcttgaaactggccatgttgggggtgattataccacagaaattgtcaagtacaacaaatcagctttttttttcctttaagagagtccatttttaaacacttaccatctcacgagtggacataagtattttgaaggcagaattgaatatggggtgtaaagagacatcagggaggattcgggagtcaaggaggcttttggactgcggcagcatttccgccatgagcagcagggcggggaagcctgcaggatgctagaactagtgttcccatcacagagagagcagggagagcttctttgtttctgagtgtgaggagtaggacccttagacaaagaggaaggataatctttttattttcttaaaaccactttgggagtgcatttgtattcaagaggcaatagagaacctcaacaaggctggggagttgggataggcaggaatctggaaggcaggataactcttgagaacctggagagcgtctgtggtttacggtcagtctcaaggcgatggatgggagtcctggtgtgtttagatttggcatgtttctcgccttctagggaggtgccgttaagtcagtgcccagagcccaatcccatggcacctgctcaggaccatgaatgaagaccttgctctggggcatccaggtctgtgtgaaggagcaacaggagcctgtgggcaggcagatgtcttgggaggggagatgtttggagccaagtctagagaagcttctcactggctcattctctcaagctgagcctctcaggaaaggaaggaggcagcagagatgagggtcccacgtggcaggggaggaaggaaggagctgtaggaaaacacatccacacttagtcatctgctcatctttcaagacatgtttcctgagagtctgttatgttctcggggctggtctcctgggatacctgtcactggtggacaggcagtcctgatagaactctgcctgctcagccatcctgccaagtcctgatgccctttccaatattccttccactcagacacacagagggtcagagcacaaacagccttcagggcttcccatttgggtttctcaacattagtttacaatgtggatttctctgaccccatggagtcccagcattcaaataatctacagatagcctgcaagggaccacccactcatcactgcctccatgaaactcctagggcactgtggacatctttgaacacatttcaagcatcccacattgtacaccacccacataatttctgtgggttgggagccttttaaagggttccccaagacttccgagggtgcggagggagcttaactccacggaccctggtgctgcatggcatgtgggctgggccttcctgttggccttgcccttctgagacagcccttggtctgtcctcccttccttgtacttacagtcaggtcttctgcttccaggggacgtagatggggcccaggaggacagctatgaggagcagcgcagtaagggatgatgccgggcctggaaatcagggaagacgaggggctatgagagagaccacttgggaggccattgtaggggcctccacttaccccatctgaggctgcctgggcccatctatgccccacctttgaacctgcatcctgcccaggctatcttcactccagcacaaggcagaagccacagaaagaggctccccattctcactcatcctgtcccaggttgccagcttattctcctggagggaagaggtggagggggtgtgtactcaggtattcatacatgtggcaacggggttcctcacttgaccctcacaagcctatgggagcagggattgtcattccattctgctagggaaactgaggcccatggattttagggagggtcacaaggttacttgcattcaaacctaaagaagctcatcactagtgttccttaggttgatccctgagaccatgtcctttggaacaaaacaagtccaaattcctagggacattttaatgactataaaagggtaggcaggtggcttgaggatggcttcacaatgagagttgcaggttccctgcttagccccagaagtaaggggaggactccgtgttctcagaacttggaggagccatggaacactggacataatgaaaccttccggctagaaaacatcctggtgagtcacggaaatgggtctcatgcttgggagggcctcagatgtcacctaggccacctccaccccagtgcaggtgtcatctgaaatctttctgttagttgggcacactcagttacggggaagcacatgtttggacgctgcatttttaacatgagcagttcaggcttttaaaatcaacatttttaacgcgagcagtttgggccattaaagatattacagtatattttaaataaataaaatggtgctggtgggtccttaaggaagaaatggagaactcagcatctgtggctgctggggtgttggaggccggcagttctcagctgggtggctctctgggacttcttctcccttgaggaaagctgcactgcccaattccaagttcactcctccttctaggggacagcccacaagaaagattggctgaattgaaaataggaaggccacgcttctctcctcaattaaaaaacactacatgacgctctcagcccttgggatcctccgcaggagcagctgggtctttgttctacctgcactgtagctcagcacctcgctcctcctacagtcctgcctccccatttcctgaggcatgctgaccctacagctcttcaggatgcttcctgcattcctgtatccatctctagtctgccttacagagaaactgaccttggtaagttgtctgtaaagcttactctaaaatataaatttgaagcctgaatactcatcagctcgcaatgaggacctcagggctggcagtgagtggggctgggcaccatggctgggatgcaattgataaaactttcactggcagtaagctgggatggcgtaaccacaggcaggaaattccttggcatcaggcttttgaaacaaattgggaaatggtagttataaggactaacttgttccatggctatcactgggcatattttttttggggaaatatgctgagaagctacgagtgattgattatgagttaaggttcagcgtgaaagcaagaggacttcttggcagcactgcactttcttatctcttgtggctagagggcagaaagaatagagggttgggccctggacatcattaaaagagtagcagaatcacagaggaggatgaatctcagcttcaacggttgctatgctggggtagggccctgatggggaagttgtgggaccctgagatgtgggagtggacatttgggtcaaagcactcaaagatcttcggttgacttaagagttgctgggtacaattgcagcagcatagctacttatctgtataaaatatcctccccaaatcaaataaaaaatgaaaacaaagtaagttctgcacaaccctggctctcagtattacttgaagagagaaagccaaactgcaaaatgaccgtgagtcaaaacagaacactcacctaaccctagtgcacagtctcttacccggctcccacgccactggtgcagcacttatgtaaccacaaggcatcttgcattttacctgccagcctagacaacttaaaatgcatttccagccttagtacctgagcaaagatgctacatctggcaaaccgaaagcacccaaaaatgccagccctggtcctggtccaagccagtgggtggatgaataactgaaaagcaaatgcaatccagtcttgatggtgcagttttacctccctgagaagtaaaactatgaaccctagaaacatcacaaggatcaggaataggagaaattccaaggtgggagaggaagaagggagactgactaggggcctcaggactgagggacagccctgcagccaggcacctgggacccatcccccaacaccagccccagccataaacggaggcaaaggaatgacatagaaaagagcaaaagcctcaagtcaattaaatcaccacttcaagaaactagaaaaagtagagcaaaataaactcaaagcaagcaggagacaggaattaataaaaagaagagtgcaaaaaatgaataaactggaaacacaaaaacaatttaaaaactcacggaaacaaagtggtcctttgaaaagaccaataaaatggaaaaaaactatagcaaggctgatgaagaagaaaacagaaatggcatattttagatatgaggttgaaacaggggatatcgccataacccttcagacaccaaaaagataataaggagatattatgaacaactctacacacaaaaatatgacaacttagataaaatggacacaaaattcttcaaaaggcacgagttaccggaactcacccaatatgaaatgaataatatgagtaaccctaaactactgaggaaattgaatttatacttttaaaacacccccaaaaattcttgaggcccaagtgtttcaaagaaaaatactgcaaagcatttaaatatgaattaaaaccaaatttagtgcacagaaagatagtcataaaagaaatttgaggaaaatttgaatgtatactccattttagatgatataagggaattgttttaataattttatgaaatttagtgattaaaaatttgaaattgtattaactgtaataatgatactggttttgttatgctgtctttagtcataagatcacccaactatggattccatttggaactgcgtgtacatgcatgactgagttagctgtggacatgatcacacgccttccatacatctctgattatagaagatattttttgccctccatttcctatatttactcttccagcagacagggacatggaaaaatccgtgacctagcactgacccagcagataagactaaccaccataaggtatgtgggaggaacctgggcctttgaaaagtctcctggagttgagactcctcctggtattacacaagagggaagtaagacatattttggtcatacggagtggaacacaggccaacttcaggtccatgggacaatgcccagcagaagaggactgtttctctaactagcacaaatttgcattttaggctgatactgaccttgtcctcagggacccagatttactttaattagtttgaaccaataacccgatctaaaggcaagaggtcttcaacaacatcccccatgacttcccaagtcctagtttccccttctttaaaactccagacttactgggtggttgaagcaaaaacagagatcatggatgaatggaaatttgcacttagtaaatttgcagaggggtttgtgattattgttgctcaaatatcacaatcaggacacagaagaggtccgttctgtgaccattcatggtcacctgcaggcctggtacagtttttttttttttttttgacagagtctcgctctgtcgcccaggctggagtgcagtggcatgatctcggctcactgcaagctccgcctcctgggttcacaccattctcctgcctcagcctcccgagtagctgggactacaggcgcccgccaccacgcccggctcatttttttgtatttttagtagagatggggtttcaccgtgttaaccaggatggtctcgatctcctgacctcgtgatccgcccgcctcggcctcccaaagtgctgggattacaggcgtgagccgccaggcctggtacagttttaaactacatttgtctttctgaaacatacacagcagatgtcagggtgtactgggatgaggtcataaatgaggatggaaaagtttggatgaaacagaaacaaagcagaggttagaaaaagtagggagcacaagggtgggctgatgagaaacgggcacaacaactctcaaggaataagggaaggcaaaggactctatgagaagatggttccccctgcctgcctctttgctccttaaatatatatttatgtacgccaggcgcggtggctcacgcctgtaatcccagcactttgggaggctgaggcgggcggatcacgaggtcaggagatcgagaccatcctggctaacacggtgaaaccccatctctactaaaaatacaaaaaattagtcgggcgtggtggcgggcgcctgtagtcccagctactcgggaggctgagacaggagaatggcgtgaacccgggaggcggagcttgcggtgagcagagatcgcgccactgcactccagtctgggcgacagagccagactccgtctcaaaaaaaaaaaaaattaaacatatatttatgtcaaaagttctattaacttgtgcatcaaattcttactagtcatgactcttcgcatgtgggatttggggggatggagctgacattaaaattttactttgtatttatagacttctagcttattttacagcaagtgtggatattacttttaaaatgagagaaaaagacaaaatttaaaaattttgagtaacctcaccaggggtagcatctgagctctggtccttctggtggactgtgacctctagggcaaggcgtttgctgaccgccagctgcccatcatgcttcacctggcaggtgaggaccacatcatccctttggtcagatatgttcaccaggaaccagcttgtccagttgtaggtaccatccttgttctctgtaagggtcgaggctgtttctctctggcacacgtttccattctccgaccaggtcagctgtaggctctgggggtagaacttcctcacctggcaggtgacgtttacctggttccccaccctcatgggctgttgagtaacctccaaggtgggtggaactgaaacagcacagggtagaagctctgatcttctggcacagacagatcacagggagggctccataacttaactcccactaccacggtgagggcatcaccaggacagtgctaggcaggcagcagatgctaagacattgagggcgctctttgcatatgaatgaaattaccaagcacagtgcctggtgcacagtaggtgctcaaggactggtagctcctactaggctaagaatgagtgaaatctacaagcacaacccctggcatgcagttggaatgtaagaactgtagcaaaatcagtgaaatcgccgagcacatagggacttggctcatagtaggtactcactaatagtagttgttcttggtgagataaatgaaactctctagcgcagagcttggcacgtgattgctggtcccctgaccgctgccaataaaatgatagtaagtgaccagcacacctaggtgcatggcgggcgggcagtatagtcagggattagattacaggccattcaacctctggagcaacagcctggggagaggggagtgggcttgacagccaggtgtgggcttgggctgggtgtgagggtcctctacctcggatggcctcagacaagttggcagtcccacgaagagggtccccctgcaaggtgacatgggccacctcgcagatgacctgagagcgaacgtcccaggggtccagtaccaccctggctgtgctgcggatgctgtaggccacactctgtcctgtggggtccacgttggtctggaagtctgagagctcattcccatttttgaaccatttcagggtgatgtctctgggagagaagccatgggactcacaggtgaaactcactgtatgctcaggtgtggtcctcgccgcagggcccaataccacgggggcagagggtttggctacaaaaggggcatcgataaacaggagacatgactgagatgacaatcactaacgatgagtgtgtgacactgttaagaaccttcagatacattaattttaatccttctaataatgtggagaggatggtgttcttattctcattttacagagcaggatgcaaaggttggaagaggtgacgaccagccccaggtcagacagtgtagggaaaggtcccagagggaagtccaggtctgagttcaaagtcctcctctccacatagggtgacttccaccaatctgggcacaggaacaaagttactgattgttctccctctgtgtattaactggtgctagcctgtttccccaggagagctcaccaacctcagagagggtgtttacagaagccaaagtagggaacaatggcaaagtggcgccaccatgagacctgcaaccaggctgctcagcccatgagaggggtggcctggaacatgcagcccctcatctgcaaagtgggacagcagcattttcccttcccaggggtgcaacaaggattaaatggggccatggaagaagttttgctttggatcaaagtcagaagatgcttcataaaaataaacacagatctgtctttaatccagacttgacatatacctagagctctctctctttgtgtatttatgaatttattccatatttttcattcttttcacaaatattccagtacagtttttgaaagaaaatgaagtagttaaggctaaagctttaacatggagtcaagcgtttgtaagagcattgcactcacacctgctaaaggtcaagccacaggatgttgctgtagacctggataacaatggactgaagtcaaggtacatgggattttgatttctctcatcctggagtgtcctaattaagtaaccaattcatacgagtttgcagtttagcatttctgccaggcaatgaactgttttcaaaaacaacattttgtgaaagtccccagtacaaaacttttcctgcattgccctatgggacactgttcaggactaccatgactcagggttcccaaattgcaactctttatttcccagataaatgctatttcctttggccttcctatcaatcattattttttttagttagcaggtctaatctgtgccaagtcccaaatttgaaaagagggaaggtttcttggaatctaggtcttcagttgggccaggttgggtccaaaaacaatgatcactgagtactaagaaagccaaaggtgggtgatttcttcatcgttaattcattacaagagacaaagatctaggccaccccaacaggcagaaatctatcctgggtcctgaaagcacacaaactggagaatcagaaaaatgagggtagtttctccctgtagatgagtcctaaacgtgtctccaaattgctaattattaccctgcacctcctatagcagtcatcaggaaacacatattaggcatacttgcatttgtaaatattaacttgctccctaccacatgcaaacattttatgggcacagtaagaagggtgtcacttgaagaagtcaagtcatcaagacaccagcagcattgggcatccctagagggctgagaggctgtaaccagttgccatttattgagggcttcttgggagcctgatgctggctgctccctctgtacctctcagctctttaatcctccctttattgccttgagggggtcctcgtgtgagtcccttataggaccagggtctgaggggaccccagctagcaaagggccaaaagtggataaaaaacccaccctggtaaggtgagggaggatgaaggcaagcacggagcctggtatgcagcaggtgcttaataaatgagccctatggctgttatcaagaggtttggtcattactacttctgaatctacacacttattctttaggcagcagaacatagaggagtagaaacaccaagaaaaggctcaaatcctgctccctgcagctcatgaaaaactcaaatgataataaaagcaaaaccaccaagtctggacaactggctttcaaaaaaaaataagatcataggtaaagctggaagcattttggaaggaggagggaacagagtcctctgtgacatctttttattattattattttactttaagttctgggatacaagtgcagaatatgcaggtttgttttataggttatgtttgccatggtggtttgctgcacttatcaacccatcatctagattttaagccctgcatgcattagctatttgtcctaatgctctccttcccctcacccccccaccccttgactggccctggtgtgtgttgttcccctccctgcgtccatgtgttcacattgtgcaactcccacttatgagtgagaacatgtggtgtttgcttttctgtccctgtgttagtttgctgaggataatggcttccagcttcatccatggccccgcaaaggacatgaactcattcttttttatggctgcatagtattccatggtgtatatgtaccaccttttctttgtccagtctatcactgatgggcatttgggttggtttcatgtctttgctattgtaaatagtgctgcaataaacatacatgtgcatgtgtcctcatagtagaatgatttatattcctttggttacatacccagtaatgggattgctgggtcaaatggtatctctggttcttgatccttaaggagtcaccacactgtcttccacaatcgttgaactaatttacattcccaccaagaatgtaaaaacgctcctatttttccacagcatcaccagcatctattgtttcctaactttttaataatcaccattctgactggcatgagatggtatctcattgtggttttgattttcatttctctaatgatcagtgatgttgagctttttttcatatgtttgttggccacataaatgtcttcttttgagaagtgtgtgttcatatactttgcatactttttgatggggttgtttgtttttttcttgtgaatttgtttaagttccttgtagattctggatattagacctttgtcagatgggtaaattgcaaaaattttctcccattctgtaggttgcctgttcactctcatgatagtttctattcctgtgcagaatctctttagtttaattagataccatttgtcaactttcacttttgttgcaattgcttttggcattttcgtcatgaagtctttgcccatgcctatgcctgaatggtattgcctaggttttcttctagggtttttatggttttgggttttacatttaagtctttaacccatcttcagttaatttttgtataaggtgtaaggaaggggtctggtttcagttttctgcatatggctaaccagttttcccagtcccatttattaaatagggaatcctttccccattgcttgtttttctcaggtttgttgaagatcagatggttgtaaatgtacagcattatttctgaggtctccgttctgttccattggtctatatgtctgtcttggtacaagtaccatgctgttttggttactgtagccttgtaatatagtttgaagtcaggtagcgtgatgcctccaattttgttctttttgcttaggattgtcttggctatacgggcttttttttggttcaatataaaatttaatgtagttttttttctaattctgtgaagaatgtcaatggtaatttgatgggaatagcactgaatctataaattactttttcatgacattcatccttcctatccatgagcatggaatgtttttccatttttttgtgtcctctcttatttctttgaagcagtggtttgtagttctccttgaagaggtccttcaaatcccttgtaagttgtattcctaggcattttattctctttgtaccaattgtgaatgggagttcattcatgatttggctctctgcttgtctattgttggtgtataggaatgcttgtgatttttgcacattgattttctatcctgagactttgctgaagtttcttatcagcttaaggagtttttgagctgagatgatggggctttctaaatatagaatcatgtcatctgcaaacaaagacaatttgacttcctctcttcttatttgaataccccttatttccttctcttgcctgattgctctggacagaacttctaatactatgttgaatagaaatggttagagagggcgtccttgtcttgtgctggttttcaaggggaatgtttccagcttttgcacattcattatgatactggctgtggggttgtcataaatagttctttttattttgagatatgttccgttaatacctaatttattgagaatttttagcatgaagcggtgttgaattgtattgaaggccttttctgcatctattgagataatcatgtggcttttgtcattggttctgtttatgtgatggattacatttcttgatttgcgtatgttgaacaagccttgcatgccagggatgaagccaatttgattgtggtggataaactttttgatgtgctgcgggattcagtttgccagtattttattgaggattttcactttgatgtttatcagggatactggcctgatgttttctttttttgttctgtctctgccaggctttggcatcaggatgatgctggcttcataaaatgagtcagggaggtgtcccactttttctagtatttggaatagtttcagaaggaatggttccagctcctcgttgtacctctggtagaatttggctgtgaatccatctggtcctgggctttttttggttggtaggctattaattactgcctcaatttcagaacttgttattggtctattcaggggctcgatttctttttggtttagtcttgggagggtgtatgtgtacaggaatttatccatttcttctagattttctagtttatttgcgtagaagtgttcatagtattttctgatgttagtttgtgtttccatggggtcagtggtgatatcccctttatcttttttttattgatttgattcttctctcctttcttctttattagtctagctagtggtctattttgttaatttcttcaaaaaaccagcttctggattcattgattttttgaagggttttttgtgtctttatctccttcagttcgtttctgatcttagtcatttcttgtcttctgctagcttttgctcttgcttctctagatcttttaattgtgatgttacggtgttgatttcagatctttctagctttctgatgtgggcatttcgtgctataaatttccctctaaacactgctttagctgtgtcccagagattctggtatgttgtctctttgttcttattggtttcaaataacttcttaatttctgtcttaatttcattatttacccaggagtcattcaggagcaggctgttcaatttccatgtagttgtgtggttttgagtgagtttcttaattctgagttctaatttgattgaactgtggtctgataaactgttggctatgatttccgttcttttgcatttgctgaggagtgttttacttccaattatgtggttgattttagaataagtgccttgtggcactgagaacaatgtgttttctgttgatttggggtggagagttctgtagatgtctattaggtccacttgatccagagctgagttcaagccctgaatatccttattaattttctgtctcattgatctgtctaatattgacaatggggtattaaagtctcccactattattgtgtgggagtctaagtctttttgtaggtctctaagaacttggtttatgaatctgggtgctcctatatttaggatagttagttgaattgatccctttaccattaggtaatgcccttctttgtcttttttgatctttgttggtttaaagtttgttttgtcagggaccaggatcgcaacccccaccttcttttgctttccatttgcttggtaaattttcctccatccgtttgttttgagcctatgtgtgtctttgcatgtgagatgggtctcctaaatacagcccaccgatggggcttgactctttatccaatttgcctgtctatgtcttttaatcgggggatttaacctaattacatttaagcttaatattgttatgtgtgaatttgatcctgtcttcatgatgctatctgattattttgcacaccagttgatgcggtttcttcatagtgatcactgatctttatattttggtatgtttttgcagtggctggtaccggtttttcctttccacatttagtacttctttcaggagctcttgcaaagcaggcctggtggtgacaaatccctcagcatttgcttgtttggaaaggattgtatttctccttcacatatgaagcttagtttggctagatatgaaattctgggttgaaaattcttttgtttaagaatgttgaatattggcccccactctctcctggcttgtagggtttctgctaatagttgttctgttagtctgatggacttccctttgtaggtgaccttgcctttctctttggctgcccttaacattttttccttcattttgaccttggagagtctgattattatgtgtcttggggttgatcttcttgtggagtatcttagtggtgttttctatatttcctgaatttcaatgttatcctgtcttgctaggttggggaagttctcctggataatatcctgaagtgtgttttccaatttggttccatcctccccatctctttcaggtactccaatcaatcatagctgtgatctttttacatagtcccatatttctctgaggttttgttcattccttttcattctttttttaaaatcttgtccgcatgtcttatttcagcaaaatggtcttcaaactctgatatcctttcttctgtttggttgattccactactgatacttgtgtatgcttcacaaagttcttgtgctacgttttttagctccatcaggtcatttatgttcctctataaactggtttttctggttaccagctcctgtaaccttttattaagattcttagcttctttgcgttgggttagaacttgctcccgtagctcagcggactttgttattactcaccttctgaagcctacttccgtcaattcgtccatttcctcctttgtccagttttgcacccctgctggagactcattgcgatcatttggaggagaagaggcaactctggccttttgggttgtcagtgttttctgttgattttttctcatcttcatgaatatgtctagttttgatctttcaggctgctgacccttggatggggtttttgtggggactttttttgttgatgctgttgttgccttctgtttgtttttctttcaatggtcaggtcccttccctgcaaggctgctgcagtttgttgggggttcacttcgggccttttcatctggttggctcccacacctggacatgtcacttgaagaggctggagaacggcaaagatgggtgcctgctccttcctttaggatctctaacctcgaggggcactgatctaatgccagtaggagcactcctgtgtagggtgtccgacaacccctattagagggtctctctcagttgggtggcacggggagcaggacccatttaacgaagcactttgactgtcccttggtggagtgagtgtgcttcagtggggaaaaacccacttatctgggctgcccagatttctcagaactagcagcaggaaaaactaagtctgccagactaagacagtggccacccctccccctaggggctcaggcccagggagatcagagttctgtccctgagccccaggctggagttgttggagttcctggagggatgccctgcccagtgaggagggatgggtcagtcctgaagaggcactctggccgcagtttgccacagctggtgtgttgggctgtgggggatacctcttgggaacaagccatctagcctccctggctccagcaggggaaaagcatggcctgcagttatagagatggctgccacctttcctttgccctgggaacttagtgtgttaggcagcgatcagtcccaatgctggctgccgcctatctcccaaggagctcagatggcttaaacagcaggcagccacagctgtgatcctggccaccccttcccctgggagctcagcagccttaaggagattctagctgaatggctgttgagaatctgtgcagctctgcggttgattgagaccctaggccccagtggcatgggctcatgagtgggatctcccgatctgagggttgcacagttctgtggaaaagcactgtttcacaggctaggtagcagctcactcaccgcctcccttggctggggggtgggggcttccctgccccacagctctcagggggcctctgcaccacactgctcttcctctccatgggtctcgccagctgcctagtcaattctgatgtcagaacctggatacttcagttggtgttgcaggatttgctcgcttttttggttcttttccatgggagcctcctatcactgctgcttctagtcagccatcttggccctgtcctgcgtgacatcttggtgttttgaggcagggagacttttggggctgaggagtactgggatttcaatgcttttttagatacacacgttttcacgatggaaggtcctccagcactgaggctggatctgagcagggctttatccggaaactctatcttgggtcctgaggcccgtactgtgggaggggtcctggccagggcactgaggcctcctgagctgtttccaccacattttttctgaagcacccacccccagaaaagctgttctcaaagccccaaccctatggggcatgacctttgccaggggactgggtatgagaatcttctggagtcatgaagagttcagatgcccaggcccatgtcagatcaattaaattggcatttttaggcggatcctgggtccaggtttgtaaacatttttgtcaaagtttcccaggtgattctaatgggtggccaagattgaaagccacgagactccaccccaaaccctatgtatccttgaggcctggaggagcactggcccacctgagatgtcatggcttcggcatcacatagttcacatttatggaacatttactgcattccaggtgctgctctgagcatgttacacgatttaactccttcagctctccctacagtctgtgatgtcggtgttatcatcaacagatgaggacaccaaggcccacagtggtggttgccttgtcccaggtcacagagctagaaaatggcagagctgggaagtggcccaggcagttgagttcttgcccatgctctcctaaccactgttctgccgaagctcagtgataaaccaaacacctccaccattagaggctctgtgcacatcctctccgatcctcacagaacctagagtaggggccatgattatcagcatcacacagatggagaaactgaggactcaagggaaggcaagactggcttaagattacacaaccttgaaatagcacctcaatttggggatgcttagaatgtgctaggtgatttacagagagaacctcaaatcattttctttctcttaaaggagttcatgatgatcaccattctacagaagaggaaactgaggctgggagaaatgaaggcactgtctccttgtcctccatgtgtcccagtgggcaccttctgtgtcccaccaagcattcatgtccattaacagagcaagtgccctgaattcttgagccccaacactgactgcacacccaattgtcccttcgagattcttgacttcatgcaattcaagggagaagcctccctcctgggtgcccaggcccagatacactgtggccagaaacaaaacactgtaggctcctgtcagcctgaggggagcatggaaacttgctcctatgggccccacgcaccccgtaggaaatacctcatctcctcatccttagtcctcagcaccaagaagaggtgggcatgtgctccgctgagctgcaggaggcccagctctgctccatagatgctgctgagtgaaggagaaacagcacaacatggggggagagtcctaaacgcttcatgtgtgctgagacctgtcttttagaaacaggcttgacatatagtgaaccatctgcagaacctttctaatgagagggtaaagccagcccctcctacccctacaggactttttttcatttgttttgttttgttttgtttttgatggagttttgctcttgttgcccaggctggagtgcaatggtgcaatctcggctcaccgcaacctccgccttccagtttcaaacgattctcctgcctcagcctcccgagtagctgggattacaggcatgcgccaccatgcctggctacttttttatttttagtaaaggcggggtttctccatgttggttaggctggtcttgaactcctgacctcaggtgatccacccacctcggcctcccaaagtgctgggattacaggcatgagccactgcacccagcctcagtttcgtctttaatgcttttcgctatagaactgaacaatgccagagtccggaaagagaaggttggagcatttctctacacttgaaaaaccacatctgagtgagtgttgcagagacaggggctgtaagtcaggctggtggggaggaaatcttggctccctgacctgctcaccactcagatctcctctctgagcctcagtgtcctcatctttaaagaggcaacaaatggctccgccctcatagcactggttataagcagactttggcacaactgccactccctggcccccttccctgcctccctcctttctcatccaggtcatcatttaggctgagagcatggcaaagaggggtgagcaccatactaggagttagcatatctgagtcacacctgagctactttctggctgtgactgcctgggctggggaggcaccatctggaaacttcggtgtctttgcctatattatctgatcagggtaaatccacttccacatctatgttcaagggtggtggggagccctgttgctatgtcatctaggagggaaattagataatattctcatatatgaaaatacacacaccctctgacttagcaatgtcacttccagtgggtgtctcccacctgaggagggtgatacatgtacaaggccatccactgcaggattgttagtagctcaagtttgggaacaacttacatacccatcaacagaatgctgtgaaataaattttgatatttccataaattggagtgttctgcagctgctaaagagtggagcagttctatgtcctgacgtggaatctcgatacggaatgttagggcttatgtttggaagaagttttccaatcaccaatgggctttagtgtctgaatgtgaggtgcattctgaacctttgggaaatggatgaaaaaagaaatcctggctccctgatccatggttctgtttgaggagcttttatttagtacctgtgatgcaccaggttcttctatgaagacagtgtctaacaaacactggggaaggaaggagcctgcctctattcggaccttgactctggctttgattccatcaataactggccatgtgactgtggacaaggcccctatcatctcttggcttaagtcccccatctgtaaaggggagttgggctgaaagtctgaaggtctttcccgtgctgaaattccaggattcaggaggtaggatgaggattctgggcctctggctggaaaccccaaataagttttattgctgctttaaattgggcacccctgagccacccatacgtatgacctcttttctgaggtgaaggatattctgagatgacccagctctgctcagagcccacagtgactgtatgactcagtccttaaatcacccaaggcttcaaatagacccacagcaaatgcgagacttattggcatctcctcccaccgggccattagactaaacagtgaatctgtgcctcccaggaatcttccctgtgtgatgtttctgaagattaaataaagaaaaacacgatttacactttccatcccctggatgaatttctcctcattagaatggaagagaatgtaagcttggtgtggggaagagctattggctgtttcattcactgctgtttgcacagcatccagggcggagtctggcacacagtgggttctcagtgagtgcctgttgcaaacttaaagtataataaaataaaataaataaaaaaaaataaaaaaaagaatatacttggccagcctgagagagaagcgctctttggaggcagaaggtgagttctggccccgtacctgggcaagtcactcaatctgtcagtttcctcatttgtggaaccaaagggctgggccagattgggaaggacaagagctgtagagccagacagattgaagatgtagtctctcccatcatttactagcaatcatttaccttgagcaatagcatgatgtccctgggcttcaactcacctgatctgtagaagggggtgacaacaggtcttgaaaatgagcactgaaaatcacacctgattgttgctcaaagaatggaaggtgttactattgagttattgtcacacatcaggggatgagggaggtccatgttgtactcaccacccaaagccatctcagtgcctggtccagacttaaactccacgttctcagggctcccttttcgaaacttcacacagtagtatgtgccgacatctgctggggtgatgctactgatgcggatggaaaagtccatgttgtttctctttgtgaggtctgaaactgttgttaccctggggaagtggccttctttttgattgtagattaattcccggcctggtccaactcctctgaaccacaggacgggtcccacgggaagcagggaggtcacagtgcagtgcagagtggctgtctttccaactgtgaccaacaggagcttctcaggctgaatcatctgtagctcctcctcacctgccacttctgaaaaggagcacaaagcaatcattttttcatccttacataatcctgtatttcctcatgtttatcaaagatattcagtgactgggtgcacatcaggaatcaggagcaggacttgatctcagcacactgcatgtattatctcatttaaccctcacaacatgcctataacataagactgtattacaattgagggcactgaggcctgaggcacagagaggttctttttttttttttttttttttttttgagagagggtcctgttctgttgcccaggctggagtgctgaggcataatcatggctcacggcaacttcaacctctcaggttcaagtgatcctcctacctcagcctccagagtagctagaaccacatgtgtataccaccatgccaggttaagctttgtatttttgcagaaacaggtcacaccattctgctcaggttgcccttacttgagtgcaagtgatccacttgcctcggctttccatagtgctgggatgacaggtgagaaccatcaagcccagccaagggattcaatttcaaggtagagttttgggttgaggacctgaatagaactcctgaactctactttgaagtgtgtatatatatatatatatatatatgtcatataagtgtcatatatatttttatatattttatatatatatatgtatttaaaaactgtcagtaaagctatgcgtcttttgcaggctagtttttgcctttccaaattctagaggctgcccacattcctttctcactgttacatcttcctatcactctaatgtcttgcttgcatccttacatgtccttctcaaagaattaatctcctttctccttcttataaggacccttctgatatgttgggtgcactctgacactagacccagtattaaaaccactgtcttaaaaatgctcaaggaagtaaaggaaaaaatggacaaagtactaaaacagcagggatataaacacattcacaaaacaagaacatccagaatgagaaattataaaaagaaatccaacagaaacttagaagttgaaaatacaacaattgaaagttcagtagaggggttccccaacaggtgtgaacaggtggaagaaaaatcataaagctgcaagatggaataattaaaattattaagactgagatacggatggaaaatggagtatagtatagagaacagaatctaagggaattctgggacactatcaagtggattgaaatacacattattagagttccggggaaaaaaaagaggaagagaaaaaagagcagaagattattggaagaaatcatggtcaaaaccttcacaaacttaataaaatacatgaatgcacaaatttaaagacactgaagaaatgcaagtttaactcaaggatagaatctgagacccacactaaggtacattataattcaactgtcaaaaactaaattcaaagaatcctgaaagcagtgggagagaaacgattcctcacatacaagagaccctcagtaagattatcagctgagctctttatataaagtattggaggtcagaagacagagggatgatatgttcaaaatgctgaaagaggaaaaacctgtcaaccatgaattctatacctggcgaaagtgtccttcaaacacaagggagaaattaagacattctcagataaacaaaagctaagatagttcatgaccacaaaggcttgcttacaggaaatgctaaagggagtgcttcaggtggaaatgaaatgatgccatatggcaactcaaagttatatgaagaaataaagatgtccagttatatgtaaattttttttaaaaaatcatatttacctgatacctccacatcccacaaacaagttgtgagcaccctgccaaaccaggtacaccactgtgataaagctggtccctgccataattcctcttcttgtcctcctcttctgtgacttagtgacactgaaacgttctagtaaaacccatcatgctttttcttggtgtcctccaccctgactcccattaaaggcaatggcttctcatctctcatctctcttgcttccccatctgcttggttgagcctactccctgggagctcctcccatatggcttcctgtgtggcatgccctacccagctatgcctctccagatgaaattctcatgaccaggttagagtgatcctttaagacacaacctgcaggacttactctaccattttcaacactaatggcaatgaggaggggattattctaaaccggggtagcaaattcctaggagatgcactttgactgttcatggcttacggatttgctactgattggctccacaatttgagaaggttttttttttgccctgatgcctttcttgtgttgtgctatgcacagctatgtgttgccttttggagtgctgccaagactctctatcctaaaatgtgtatcctattccaatatcaataatgacagctgcctttcttcaagagcacaggatgttatagcaacctcttcaaagaagactcatgtgatacttataataatatcacataatccagcatctctgagttgttttgaggtgccagtggcaatgtattctacatttacaaattttacttgcaaattaaaatcaacaggcactccttttagtgctttcaaacaaacaaaaatacctcttctctctagagactttggcaatgattttcattcctcttggaatttctagaccactcctgatggtcataaacttccccagggcttctaacgcaaaacaaaaaataaaacaaaacaaaaaagcccctctctgccttgttctttacttcattctaacaaaaaatgactggttatctactagaatctactggcttgtggtccagatctagggggaatatttcctgttgcaagcattaaccactggttgtctcacaggccagtccctgctcatctgaaatgggtcccactggaacttaaacttctactgaaacacaaaattaaaatttgtcaggtgcagctgcacacctttctgttgacagtggccttattactactggatttgttgatgcaacaatcctcaaccaaatactagctaactgaattgaacagcatgtaagaaggattataaaccatgaacaagtggtatttattcctggaatatgagtatgtttcaatatacaaatgacagacaaacaatatggtattctacaaatatttatttatagaataaatagaaaaaacacatgatcatctattttgatgcagaaaagcatctggtaaatttgtacatctatttacgatgaaaacaataaaaaggatatatgaatactttcacaagatgataacattcacctactcatactttatttttattgcacttatcattgtcaaaaattaattttttcattcacctatttatcatgtgtattgattactgtctttctctgcagtggatgtaagcaacaaaagggcaattactttttctcttttattctaccaaagtaccccatgtttttatgtcagatcctggcacatagtaggtatccaatagatatgtgtgtaatgtttgaattgctcagtgggacatttccctcgaagactgaaatcttctattttaggtggtttgctcctgtggaatttgacagaaaatgagtttcccatgtagaggacttagtgaaaaaaaatcagtttgcaaacatacagaaagtagaagagcccagagaagaaaaccacaatctcccttcacaccacattgcccactccacacccaagagcagcagctgcagaaatctcatggaatagaatcaagaccggaagtgtttgagtaatggtgaaacctgtgacctctagagtcagagtgcctgagttcaaatcgtagctctaccagttaccaatgagtgagcctggagcactttgtgcttctgttttcttatctgttaggaaaggtgacaagaatatctaccttgtatataatgatcacatgaagtaaaagaggtaaggcattttcaacagtgtctgccacatggtgaacgttcaaaaattgtaaagttattgctcagtagatttctgaggcttggaggcttcagtggacattagatgacaaggataaggataagggtatggatatggatataaatataactatagttataggtaatataggcagacctgtgtcacctgtatccccacatttttttcctcatttctaccttcatggaagagggaatttcaggataaaaatgcacagaaattctgctttgagggaaaatgcattttaccaagagagaagtttgcttatctgttgcttctattaacagattggaggactttcagtggtaagattagagaagtaggaaggagggagagtggctgggcaatagggaaaaccacacatctcttcaatgtgcatttcatatagactgaaaaaatgagttgaagtttacagtaaagaaagtctttaaaattctgtgtgtgtttcagcatggtcacatgagatttatctcaggaatgcaaggatggtataacattcataaatctccaaatgtgatatgctacatcaaggcaatcttgagcaaaaagaacaaagatggggccgggcatggtggctcatgcctgtaatcccagcactttgggaggccgaagcgagcagatcacgaggttaggcaatcgagaccgtcttggccaacatggtaaaaccttgtctctactgaaaatacaaaaaattagccaggcatggtggtgcacacctgtagtcccagctacttgggaggctgaggcaggggaatcacttgaacccgggaggtggagattgcagtgagctgagatcacaccactgcactccagactggcgacagagcaagactgcatctaaaaaaaaaaaaaaaaagaacaaagatggaagcaccacactgcctaatttcaacattgactacagtgtcaaagtaatcaaaatggcatggcactggcataaaaagagatatatagaccaatggatcagagcagagagcccagcaataaactcacacattcacactcaattgactattgacaaaagtgtgaagaaaacacaatggtgaaaggtctgtctcttcaaaaagtggtgctgggaaagttggatatccatgtgtaggggaatgaaattaggccttcttctcatgcctcatacaaaaatcaactcaaaatggattaaagatttaaatgtaagatctgaaactgtacaagaactagaagaaaagtttcatgacattggtcttggcaatacatttttggatttgagccccaaagcacaggcaacaaaagcaaaaatagacaaaaggcattaacaacaaactaaaaaagcttctacccagccaaggaaacaatcaacagagtgaagagacaacctatagaatggaagaaaacatttgcaaaccatacatctgataaggagtcagtatacaaaatatataaggaagtcaaacaactcaaccataagaaaacaaccctattaaaatatgggccaaagatccgaatagacatttctcagaagaagacattaagatggcaagtcagcgtataaaaaaaaatccaaccttactattcatgagataaatgcaaattaaaaccgcagtgggctatcatctcacacctttaagaatggctattatcaaaaagaggaaatttagtattggagaagatgtggagaaaagggaacccttgcagacagttggtgggaatataaattagtagagccattagtgaaaacagtatgcaggttcctcaagaaattaaaaatataactcttatctgatctggtaatctcactactggcatatatccaaaggaaatgacatcagcatgtcacacatatatctgcactcccatgtccattgcagcattatttacaaaagccaagatatggaatcaacctaggtgtctatcagcagataaatggagaaagaaaatgtagcatatatgcacaatgaaattctaatcagccttacaaaaagggaaaccctgtcatttgcaacaacatggatgaacctggaggacattctgctaagtgaaataagccaggcacggaaagacaaacactgtatgatttcacgtatgaagaatctaaaaagttgagctcatagaagtagaaagtagaatggtgtttatcgggggctagagagggggtgtagttggggagatattagtcaaaggatacaaaatttcaatttaaataagagaaataagttcaagatatctattgtacaatgtggtgtttatacttaataatatgaattgtattcttgaaaactgctgagagagcagagtttacgagttctcacaataaaaaatgataaatatgtaaggtaatgcatatgtttattagttcaaattagtcattccacaatgtatgcatatttcttaatatgttgtacataagtatacatacttttgtcaaataaaaataaaataaaatatttattttgttaaaaatttcactgaaaatagaaagagaaccaatgattaaaaatgaaatctcatctgtgcatgtacatgtacatgcataggcacatgtgcatatatatgtgtatataatgtgtatatatacacattcacaaatatatataaaagtttggcttatcatgttagtatataaggttgttttgtgcattaattacaattatgacaaatttaaaaatctcagtaaaatatttggcacatagaaaccatccaacacatttttaacattttgggaaaacatacatacactagtgttttacctctgattgtttctgactggtgtgatgggtgattattaatctaatgtttgcttgcctgcattttctaatatttctacacatagcataacatggttaaaagggtgataaactctggaactggtcaacctggacttgatcccaactgctccatggactgaagtaggggacaatgaacaggttcctgcctctgcctcactccccatttgcaaatagagcacaagagttatagcttccacacagggatgctgtgaggattagttgacttaatacacacaaaatgctaagaagtgcatctgccttacaggaagagagcaattgctgaactattactgctgtcatttgggtacagtgtatgtgtaaaaaaaataatttgaaaagtgagaccttgccctctaagacctgtgagatgacatcacagcagggcccagtgggcaactgagaggctattgtgcccagccctgtgaccgggggtcagctgcatggtctgaaaaaggggtgaagacaggcagcctgtctgggagctgtgaacagggctctctcaggtggcaccaggaaagacctcccaatcctgtctgcctgggggaagggaaaataaattctccagaggaaagtcaagatgaccaagggagatggtggtgcctgttatgggctgaatgtgcccccaaaacgaatgggttgaagccccaatccccagcgccttagaatttgaccatatttggagacaaggtctttaacccatttatgcccgaggttgcaatttttttttaatttgaaaaatcagaccttggcgatgcccttgagcagtaggatataaataactcccgcaagcttagtgatccaataacggagcactaggcataaatgggtgaagcaatttagttaaatgaggtcactggcggggagccttaatccaatatggctgatgttctcataagagaaaatgagaatacagacacacacagaggaagaccatgtgtcaagacacatggaggagatggccttctacaagccaaggagaaagacctcagtagaaactaaccctgctggcatcttgattttgcaattcagcctccagaactgaaagaaagaaagtaaatgtctattgttttagttactgagtctgtggtgctttgttgtggaagccctaagaaaggaatataggacgctgtaagcatgaaatgtggaacttcttaaagaggaggagggcacacaaaaatgggtaggaggactcaagacaggtaaggatttaataatgattcttctgtgtttgtcaaataaaatattataaaaatgtaactaattgtgatggtggcagaagcctcacaaggtttgatgcctctggtagccagctgcagatccacagagaaagtgctcagctccctgatcttctgctcttggacaatgtccagtccttgaccttccttggcagtgcttgtgcttatctgaaattgctgcaagtccaggggcaaggctaggtccaggaagcagggagaaagggttctagcccaatgcaatgctcacctgtaagtcccagcagtagagtcagaagcaggaaaggaccaggaggatggggccaggaggctgggacaggcattttggagacctcagaagcctgctctgttcaaacgtctgttctggggagatgtcaggccctgctctgaagacagaagacaagccctgcctccctcaattcaagaggaagtggctatgatggaatgcaacagtaacctgcttctagattgtgacttacaaatcaggcacagtaggcagctacaaagcaaggagttaatcgtgctccattttcaggataatcagacagggttagcagaaataatgcttcctgcctgcctgggacctgtgctccctcctcgtgtccccaaacccattttcaggtcttcttggtgatttgccatttgaggcttttaagtcaagaaagatctgttgttaggtattgttttctaaagtctttatttcaagaccctaggatgtggttggcttgtggtcttgttctgcaccagcctcaaccaaatgccactccgctggacgtaggagaagagttcacaggacctgctcaacactggagaggaaccagatcttctcctgaaatgattttctattccaaattgctataattggcaacacttagcccaaattcagtctcttgtggaccttagcactttcatgtgcctgcacccagcagaaggaattatttcttgactccttccaggagagaaactgggtttgaggtaataagcaactgctttgtggagtgaggtggggattgtgggttatggaaaggggatagggttatcatgagggaagattatggtgggcaggttcctggggccgtcgcatcaatttcaataccctttcttctacacacagagcacctatttcattcatcactgagttcggatgggaaatgaggaaagaggaaaaatccatgctcctgccaagagtgtgtgccaaggagttggggaagtcgctgggccctcctatgctcagtttcaatctcctaaactgggaatagtaagtctttttgtgcagtgttttagtgacgattaaagaggtaatgagcatatcatgcctgaaacccagtaggtcattattgatactcacggtgccaggtgaagtgcgggaactcaaatgttgcttttgaatggatccctcctgcatgctgagttgcccaccagtggctttctcccagcaacccaggcctcctgagacccagcttatatagtgtatttggactctcgctgccaccctgaaatcagtttctccctctggattctctaaatcccgctccttgttcaaccatagattaattcctcctcttacaatttccagctgtgtgattttcaaaaagacactacttctctgagccttggtttgattgtatgtaaataaatgttagaatatgcaccttgtagagctatggtaggaataatataagccatactgaatgcttgactcataattaattataagcaaaaaaacatggctataattattttctgtgtacaggaagagtccactggttctctgccaccgttgtgccttagaaaagccaccttgttaaaagaaatgatttctcttccagcatctatgactaagaaagacctgtccagaatccttcatctcacatgtgggttttaggttcttaatctgtcatgaataattgtcaaatcaaattgtaaatgttatcatgttttaattgaaagtcctgttttaatgtggcagatgtacacagggtgaaatcttcccctccttctccacacccacagtagtgaaaacacaaaatgaaaagaatatatgaatcaatgtctaattacacttgaatacaagcaattggcttctatatgacatgaaggaattataacagctatcatttattgagagtttcctgtgctccagatatggtgccaagcatttttctattggtaatgtcattaaatcattgctctgaccccatgaggtaagctcaaccattaacctcctttcacaggtgagaaaacccgaggcacatggagagtaatgaatttgctcaagatcacccggcttttagaactggaacataggctgccacactccacagccttcacttttaatggttgtactatgatacctcttgcaggaagggagagacatccctcaggaagaaagcagagaagaagctatagcctcaattaggagcagccctcatagtgaggctggggcaggtgccatgctccacgaggccctgacaacccatgatcacatggggaattattcctgggaagacggaagtgcaagcaagaatcaccaaagatttgaggaacagcactgcagctaacaaattcaagaaaaacaataactcaaaaacaaatagcaatcaaaagaacttcacacctgagcaaatatgaaaaaacaaaatgtgtaaagttctttaaagttagtatacttaatgatcttataaggaaaacaaaagagaagtaaattcataaaccaacatcaggcatgtaataatatgaaacagaaataggcgggcatgaggtaacaacaaccatcttgaaaaaataccaaaacacagactttggaaatgaaaacataatcagtgctgaaattttttaaaaaaacttaataggttgactagctgactatacataaataagtataatagtaagttagtaagctgggtgattatgtaggggaaatttcctgtggtacagcacagagacacacccaaacaaagtaatgtggataggtaaaaatataccacaatattgtggtatatcttttcctattgctctatttttacctatccacattactacattactttgagaggtgtgagtcataaagtattatgtctccaaaaataagaattgggcgtatatgactcaaaaatgcatagtatagtgtcaggaagatggcagaatctgtgcttagagcagcaagtgccttcctgtgaacttcaatccttcagtaaagatcaactaagtacacagatgcttacaatttttgtggaaatcacgtggagaattgaaatttaaatttaggtgacttggggaagcatagataaaatctgaatgtttgagaggaccaggaacctgggagtccatgagccaaaattctcctttatctgccatatttcaccctgactcatcacagcaggtgcagataaccagggacgactttgggacacatgagaaactgggagccagtggatgctccagaagactaaagatgtaagactgtgggcttaagaatcaaaacttcctggtctgaaatccagctctaatgggtcccagctgtgtgatcctggggtcactattaacttccctgtttcctgagtttccccaagtgtacaacggagagaataatcataccatcttcataagtttgtgatgagaattaaatgaactaatatatgcaaattacttaatactatctgaccatgtcctccaaaagttatatattcagtattaccattatcattatagatagtagttagatattatcgttattaggtagtgttttggtaatagcaacaattttaaaaaacagatcctctgccctcaagaatttatgatgctgtgtgacaaccttggccagtggctggtggaggtggagtacgacgatgatgagctgaggtcatgtgcccagccctagaatcatggagtcattaccagcaccaggggcatgctataggcatgacgtctgggggaatcaatatgaccccagtaagggtctactcaaatgctcatggaaaagctgttccaaatcttgtctcatgctgggatgggagagaagaaaatgctcccaaatgtaaatcaataggagcaggtaacatgggctgagagggtgaggagacaccatgtagaaatacactcatgtagagcaggctgcactcactcacctgtgagtcctggtagcagaggaagtggcaggggctgtccagatgggctgggagacagggatggacattgcctgccctgtcagactgtctcatggagagaatccagactctactctgcaggaaaggagggcatctgcttatctgctatgttgtctgaggagtgaggtagctgtagggagaaagggccatgagactgggacaatcctccattgtgaaagaggaagtggacacagttgccatctctgggaagttgtggatgtctgtgcttggggttcccaggcctgggtagatttagccagtactggagagaggtccactgccccagaacctgctctctgtttcagaggcactcatctcatgccaggggtcccatgacccttcctcattgacagcccagaccaagagggctctgtagctaaggactgagcttgcaatttcagagaccataattccagatgtggcacatttgagggcttgtggctgtagcagctttctgggatgaaacccagtcccctgcacaacccctgcaaaaagtcccttaagtcaacaccaaggaaccagctgagcaaatcaaaagtgacatttcttcttagatctgtcagaaaaacgaggtcacagggcaaaccactgtccccagaattgaggagttgggcagggtaatatagagaatcacaacttcctgaagccaaaacctctgtgggaaccagtgccggggaaggaaagcctgcactgtaattgaagaatttcttgaggctcagtgtgggccagtcttagacacaaactcgaggaggacccaataacggaggtctcccacacttttgtgagttttatctctgggagcttggttagctcgtcagagtgaatataggagaaatattcacttgtgctcccaggacacggaaaggaaaagcaatcacttaaaaatataccagagtgtcctattgttctttcgcttgttccatatagtaaatatgcaagacaaaggcaagcactgttccaactactgttgatacatttttagaaagaaataaaacaatttaactctcaatgtttctaatgctttgaattacagtatactaaatatttgaacttcctgctacatttctaactgacaatatgacagtttctaatactttgacaacaattatgaggatcacagaacaaccattatttttcccattgaatgtagagttgtttaccagggcttcatggtttccagttatttttacaatcctgcactgccatgcaaagtgaggacatgcaaaataagtacacgtggtaatataatacagtgctgaggagaaaaactgatcaggataagaggaattgaaattctagggtaggagaggaaaatgactatttttcctcaccatggtttacaaaatgtgtctttaataaagtgaaatttcagcagaaacttacttgaaggaaagaagagagtgagccatgcagctgttttggggaagactcagaggaatgacaggatttgacttttcaaaaaaaaaaaaatcatggcccggcgcggtagctcacgcctgtaatcccagcacgttgggaggccaaagcgggcggatcacgaggtcaggagatcgagaccatcctggctaccacagtgaaaccccgtctctactaaaaatacaaaaaattagccgggcgtggtggtgggcgcctgtagtcccagctactcgggaggctgaggcaggagaatggcgtgaacctgggaggcagagcttgcagtcagccgagatcgtgccactgcactccagtctgcagcctgggcaacagagcgagactccatctcaaaaaataaaaaaaaatcatcgtgactgaaaactgcaatccagtagagacaatagcaacagtttggaagagatgatactgattgggaccaggaaggagcgatggaggtgagaagcacgcaggttataaatataactcagtggtgtactggagcaggcttgggctggttcaagacagccaactgtcaaactttaaggaattttgcaatctggttgttaaactgttggaagcttgaaactggctacattgggagtatttacactatcaaaattgacaagcgctataaatcggccttctttttccttttgaagagtcaactgttatacgtttatcatctcatcagtggacataagcactttgaaggcataattgaatgttgcgtgtaaatgaaaaagaaatcaaagaggactccaaagcttttgaactgtcgcggcattcctgccatgagcaacagggttaggaaagttgcagattgtcagaaacaactagtgtttccatcccagagagaggagggagaactgctttctttttaggtgtgaggagtaggacactgtcttagtccacgtgtgttgctataaagaaatacctgaggctgggtaatttataaataagaggtttatttggcttgtggttctgcagactgtacaagagcatggtgtcagcatctgcttctgatgaggccctcggactgcttctactcatggtgagagacaaagaggagctggcatcacatggtgagagaggaaggaagagagagagagaagagggaggtgctaggctctttgtaacaatcaaaccttgtgaatactaattgagcaagaactcagttattactgcagacggcaccaagtcattcatgatgtatctgcccccatgactcaaacacctcccatcaggccctacctctaacataggggatcaaatttcaacatgggatttagagagaacaaatattcaaactatcttggatgcttaaacaaagaggaaagagaactgtttttttcccttaaaactgggatgggggttcatttgtattcaagaggcaatagagaacctcaacaaggctggggagatggagtaggcgggaatccagaagacagaataagtacggaaaagctggagagagtctgtggtttatggcctgtctcaaagtgatggatgcaaggaatcctagtgtattcagatttgatgtgtttctcacattctagggggatgctgtgagtcagtgcccagagccccattccttggcccctgctcaggaccatgtgtgaagactccactctggggcatcaaggtggcagagactgagggttccacatggcaggggaggaaggaaggagctgtgggaaaacacgtccaggtttaatcatctgctcatccttcaggaaatgtttccggagagcctgttatgttcccggtgctgatctcctcctgagatgtctgtggtggttggacaggcagctctgagataggactgtgccagctcagccctcctcctgagtcctggcgccctttcccgcatcccttccacgcaggcactcagaggatcagagtgggaacagctttcagagttgcctatctggggcttctcagcattactctacagtgggattccttagaatggagtccagcatcaaataatctagaggtggcctgtgagggaccacctacagagttgcccctcacttagcaccctcttctcacctccccagcaggcccctaaggcaccgtggacacctttgaacagccttgctgtaacccacttcctgcagcacccacacacttcctggggctgggagcctcttagagggtttcctgagactcccaagggtgcagagggagctcggttaccttctctaaactccactgagcctgatgttgcatggcgtgtgagctgggccctccggctggccttgcccttctgcggcaacccttggccagcccttctatccccacacttacagtcaggcctctgcttcagtggatgttagatggcagagacatcaacccccagcagggccctggggcccaggaggagagctacaaggagtggggcagtaggagctggcatgagccctagaaatcatgagactccaggaggagccatgagaggggccacctgggatgggcctccgcttaccccatccaaagctacctgggcccaacaaggctccaaaacttttgaatctgagtccttccctggatgccctggatccaacccaaggcagaaaccagggaaagaggctccttctttccagtcaccccatctcccggtgccaggctctcctactggaaggagggggttgagagagcttgtactcaggtattcatacattgcaaggaagccatggacttgtttctgaaaggagtgacgcctcctcaagaagagcctcacaacttagtctaattttccatttcccttattgaaggttaggttatgtatattttcacaagtttaaaagccctttgtttttctttttatgtgtactatttatgtcattttgcccatttatagttgggctgctgggtcttgttgatttttaggaacgtttaaatataaattaaaatctggtcttttttggatatatataaaaaaaagagcctcaggcacgtccttcaggagggattccagaagaaggcattgttctcctaggagatgacagctctaggcgggttatggcccctgaaggccttccagtgggacaagatgcgaaggtggaagacagcactattgctgatcctgaccctgtaggcccaggctaatgtgcgtgggaggtcttagtttttaacaaagacagtttaaaaaagaaaaaaaaaaaagacaaagttctaaactagcaaaaacctcatagaataaggatgtaaagagaaaaaaatttttgtacagctataaaatgtgtttgtttcaagctgagtgttgttactaataagtaaagttaaaaaattaaaaacctcataacatgaaaatgttacagcaagctaaggttaatatattattgaacaaggcaaaatattttaaaaatcaatttagcatagcctagaccaggcattgtgtcatgtgtatgtagtcccagctactcaggaggctgaggcaggaggattgcttgagcccagaagttctggattgagtgtgtgcactaagttcagaatcaatgggctaacctcctgcaagaggagggaccaccaggttgcctaaggtagagtgaaccagcccaggtcaaaaacggagcaggtgaaaactgtcatactgatcagcagtaggatcatacctgtgagtagtcactgcactccagcctgggcaacacagtgagaccccagctctttaagaaagttaaaaataaaaaatgtatatacatttagcatggccaaggtgtatggtgtttataaagtctacatagggtagtttcctaggacttcacgtgcatgcatcactaactcactgacttacccagagcaaacagttctgctagctccattcatgagaagtgcccaatacatgtgtaccattttaaaaaatatttttaaaaaaattattaaaaaatattttatatcatacatttactgcaccttttaatgtttagaaatgtttatttacttactttttttttttggacaaagagacttgctctgttgcccagactggagtgcagtggcgtgatcgcggttcaccacaccctttaactcccgagctcaagtgatactcccactactgagactacagctgtgcatcaccacacgtagtcaatttttaatttttctgtagagacagggtctcaccatgttgcccaggctgatctcaaactcttgggctcaagtgatccccctgccttggcctctcaaagtgctgggattacaggtgtaagccacaatatctggctagaaatgtttagatacacaaaaactactgtgttctaattgcctacggtattcagtacagtaaaatgctgtaccggtttgtggcctaggagcaagaggccataccatatggcctaggtgtgtagtatgtagtaggctatcccttctaggtttatgtaagtacactttgtgatggtcatgccaaaaccaaattagcttgttgatagctgttgtgagaccttggttcttgtcttcttagtttaaaagaatttaaacaagagacacacagcaaaggaaatgcagcatagagtaatttattgcaaaaggaaaagaatattttgaaagttatgtgcagaatagatggtacctcctgagagagagagagaggattcaaaacgggttgttcataaggataagacagcaaagactggcactagggaggctccctttaagggagtcttcaatgattattcataaggaggtggaaagaggtgttgcaaataagcatgttctgggcagtcctctgggtgcacctgagcagtggctgtatatgcttgttcatacattgcatagctcattagcatcttaaatctccacccagggatgtgttttttactattataatgagcaaagggtcagtttgaggacaggtaaagtcaaaatgcacagaggggaagtccctactatagatagctttgctttaatcagctcaattagaatgccaatgctgagtcttattgtattgactgttctgccatcactcttgctgcatcctgagaacagggttacttctttgactacctatcctccctcaagctaatgacacattactcaggatgtatccccttcattatgaaatatatgaacatgttaaggaaattgaattgataattttaatacttctgaaaatatatcttgaagaccagatattttcacaggagccctttctttctttttctttctcttttcttttctttttttcttttcttttcttttcttttctttctttctttctttttcttttcttttctttctttctttctttctttctttctttctttctttctttctttctttttctttttctttttcttttctttctttcttttctttctttctttctttttttgacagagtcttgctctgtcgcccaggctggagtgcagtggcatgatctcggctcactgcaacctctgcttcttgggttcaagcgattcttctgcttcagcttccggcgtagctgagactacaggcacacacccaccatgcccagctaatttttgtatttttagtagagatggggtttcaccatgttggccaggctggtctcaatctcttgaccgcatgatccaaccacctcggtctcccaaagtgttgggattacaggcgtgagccaccgcacccagcctttcacaggaatattttaccaaaaaattaaagaggaattaaaaccaattttagctcacacacaccacacaaaaaacagccatgaaagagatttgagaaaattgtaaaatatacccaatttagatgatatgaggaaatttttgttaattttattaactgtgataacaatattgatcttgtagaaaaacgtcctcaatcatcagatcacccaggatggactccatttgcaactgcaggtgcatgcatgactgagtgagcagtggacgtgactatgcaccttccatgcatctctgattataggggaaattgtttgtccttcacttcctatcttcactcttccagcaggcagggacatggacaaatcagtgacccagcacagacccagcagatgaggctaatgtcttagggcatgcaggaggaatccaagcctttgaaaagtcttctggagcagagacccctcctggtattgtatgagagggaaacaggacatattttggtcaaagagaggggaatatcggccaacttcagatccttgggacaatgtctagcagaagggaatatttctctaattagcacaaatttgccgtacaggctgatagtggccctgtcttcagggcctcaaatttaccttgattcgtttagactaatcaccttgtctaatgacaagacatcttcaacaacatcccaacatctctcattgttcctcaagttctgagtttctcttctgtaaaactccaaactactggatgtttgaagcaggaagggagagtatagatgaacggaaatttgcacgtagtaaatgtgcagagggatgttgcggttattattggtcaaatatcagcatcaggacacagaagaggctcatgctgtgaccagtcacggtccccagggggcctggtccagtcttaaatgccttttctgattttcccacagcagatgccagagtctgctgggatgaggtcgcagatgggatggaaaagtttaggacagaacaaaaatgagtcagagaaagaacagcaggagggctgatctgacaaggaatggagaacataagtaaacatctgagacagaaggcaaaacacaggactccatgagcagatgatctccctgcatctctcttcctcctttaatatatatttgtgtcaaaagatctaccaagttgtgcatcaaaatcttagtaatggtgactcttggagtgtgggatttggggtagacagctgactttaaaaatctactctatgtttatagatttctaggttattttataacaagcatgactattactattaacattaaggaaagagacaaaattttaaaatcgggagtaacctcaccaagggtggcctctgagctctgctcctggtgggctgagacctctagggcaaggcttttgctgaccaccagctgcccatcatgcgccatctggtaggtgagcacatcatccctgtgggcagatatgttcaccaggagccagcttgtccagtcgtaggtgccttccatgttctcaatgaggatggaggctgtttctatctgggacacatttctgttctccaaccaggtcagctgtaggttctaggggtagaaattcttcacctggcaggtgacgttcacctggttccctgcctttatgggctgttgagtaacctccaagaagggtggaactgaaacagcacagggcagaagctctgaccttgtggcacagacagatcacagggagggctccataaagtagctcccaccaccacggtgagggcatcaccaggacagagctaggcatgcatcaggtgctcagacattgagggtgctctttgcatatgaatgaaattactaagcacaacgcccagcacacagtaggtgctcaaggactggtagctcctactaggctaagaatgagtgaaatctgcaagcacaacccctggcatgcagttgaaatgtcataactgcagcaaaatcaatgaaatcaccaggcacacagggccttggctcatagtaggtgctcattaatcgtagttgctcttggtgaaataaatgaaactatctagcatagagcttgctagctatctagcaagctagcaagctatctatctatctagcacagatgtctaccacctggtgggtggacatctagctgctaccatggaaatgatagtaagtgaccagtacatctaggtgcatggaaggtgggcagcacagttaggaattagattccaggaaatccaagccctggagtaaaagccagagaggaggagcaggcttggcaaccagatatgggattgggctaggagtgaggattctctaccttgaatggtttcagacaagttttcagtcccacaaagagggtccccctgtaaagtgatgtgggccacctcgcagatgacctgaaggcaaaggtctccagaggccagcaccatcctggctgtgctgcaggtgctatagggcatactttctcctgcagggtccacgttgatctggaagcctgagagctcattcctatttttggaccatttcagggtggtgtttcagggggagaagccgtgggactcacaggtgaagctcactgtatgctcagctgtggtcctcactgcagtgcatgataccacaggggcagaggatttggctacaaaaggagcatcgataaacaggagacatgactgagatgaccatcactaatgatgagtgtgtgacatgttaagaaccttcatggacattagtttttaatccttctaataatgtggagagggtggtgtcctcattttaccgaccaggctggaaaggctctgagaggtgaggaagtccagacctgagttcaaagttctcctctctaaacagggtgacttccaccaatctgggcacaggaacaaagttactgattggtctccctctgtgtatggactggtcctagcctgcctcccctggagagttcaccaatctcagagagtgccgagaccagctcggtcagggagaccctaacccagcggcgctagaggaattaaagatacatagaaagtatagaggtgtggagtgggaaatcaggggtctcacagccttcagagctgagagccttgaacagagatttacccacatatgtattgacagcaagccagtgataagcattttttctatagattatagattaactaaaagtattccttatgggaaataaagggatgggccgaagtaaagggatgggtctggctagttatctgcagcaggagcatgtccttaaggcacagatcgctcatgttgttgtttgtggtttaagaacgcctttaagtggttttccaccctgggtgggccaggtgttccttgccctcattccagtaaacccacaaccgtctggagtgggcatcatggccatcacgaacatgtaacagtctgcagagattttgtttatggccagttttggggccagtttatggccagattttagggggcctattcccaacaagagagggcatttacagaagccaatacagggaacaatggtgaagtggtgccattgtgagagctggaaccaggccgctcagcccaggagacgggtggcctgacacatccagctcctcttctgtaaaataggacagcatttctgcttcccgggatgcagtgaggattaaatggggccctgtttgctttggatcaaacacagaggatgcttcatataagtgaacacagttctatctttaacccaaatttcgtgaatacaccgagatctctctgaggtatttatgaatttgttccatatagttcattcttttcacaaatattccagcaggatctgtgaaagaaaatgaagtaattaaggctaaagctttaacgaagagccgagagtttgtaagaacattgcacccacacctgctaaaggtcaagccacaggatgttgctgtagatctgagtaacaactgaagtcaaggtacgtgggattttgatctctctcatcctggagtactttaagtaaccaatgaaaacaggtttgcagtttagaatttttgcccagccattgaattgtctccaaaaccaacttttttgaaaatcccctatacaaaacctttcccgcactgctgtatgagactctattcagcacttctctgactctgtatacccaaagtacaattctttatttcccaaataaatgctatttcttttggcttttcggccaatcatttgttgttgttgttgttgttgttagcaggcctaatttgtgccaagtgctgcctttccaaagagggaacgtttttggaatctgggtcttcagttgggtcaggtttgggttgacaaacaagatcactgagtactgagaaagccaaaggtggttaatgttttcatcattagttaactacaagaaacacagacccaggccatctaagcaggcaggcactcatcctgcgtcctgaaagcacacagattagagaatcagaaaaatgaaggcagtttctttccatagagaggtcctaaagggcacctccaaattgtgaattactaccctacatcttctacaacaatcaccaggaagcatatatcacacatatttgcctttgtacatattaacctgctccctaacatgtgtcagacattttgagggcacagtaaagagggtgtcacttgaagaagagaagttatcaagataccaccagcatggcgaccctaacgggatgagaggatgtaatcaatttccatttatgggagcctgatgctgcctgctccctctatacctctctttaatctttttaacccccctccatccctgtgagggggtcctaatgtgagcccctttataggatgaggctcagagaggaggcccggctggccaaggaccaaaagtggacacaaaccccaccctggtaagataagagaagacaagtgaaaagcacagagcctggcatgtcgtaggtgcttaacaaatgacccctgtgactgttttcaggaggtttggtcattactgcttctaaatctacacatttatcctttaggcagcagaacaaagaggagcagaaacaccgagaaaaggctcaaaccctgctccctgcggctcatgacaaacccaaatgacaaaaggagcagaaaccaccaagtgaggattctctccccttttctgaacaatcccctcaggaaacaagtttggcaaattggctttcaaaacacaaacaagatcacagatgcttccctccagaggagctatttacagaagctggaagcattttggaaggaataggaaacagattcctccatgacatcttcgtgtgtggaggcagggaggctcctggggctgaggagtgaggatttgctgggatttcagtgctgtttaaacacaaacttgttaaagttgttcccaacactgaggctgggatctgagcaggacttagaccaggcttctcctccttgtcccctaaggcctgctccatgggaagggtcctggccaggccactggggccttctgagatgtctctggcccatgttattctgaagcatccacatccagaaaagctgctgtcaatgctcaacacaatggaggaccacttttgctagggggctgtgtattagaatcttctggagtcactgagaactttgcatgcccaggctcatgtcagaccaattaaactggcatttttttttaggagggagccttgggctggatttaaatttttttttttcaaatttcccagatgattctaatgagcagccaagatcgaaagccaccagaccccaccccaaaccccatgtatccttgaggcctggagaagcactgacccatctgaggtctcatagcttcgacatcacacagttcatatttatggaacatttactgcactccaggtgctgctctgagcatttaaaaggatttaactccttcagtttctgtccccagtctgtgaggtcagtgttatcatcaacaggtgcggacactgagactcactgtggtagagcaccttgtcccaggtcacagagccaggaagtaccagagcccggaagtggcccaggcagttgggctcctgcctgccctgcactaaccactgttctgcggaagctcagtaataacctgaacaacaccaccattcaggactctgtgcacatcctctcccatcctcacagaacccagagtgggtttggtgcatgattatcagcattgcacagatagggaaactggggactcaagggaaggcaagactggcccaagatcacaagaaataacagcttgatttaggggtgcctacaatgtgctaggtgatttacagagagaacctcaaatcctatcccctctcctaaaggagtcgtgatgatcaccattttacagatgaggaaactgaggctgagagaaatgaaggcactgcctccttgtcctccatgtgtcccagtgggcacttcctgtgtcctaccaagcactcatgtccattaacagagcaagtgccctgaattcttgagccccaacactgactgcacacccaattgtccctttgagattcttgactttatgcaattctagagagaagcctccctcctgggtgcccgggcccagataccctgtagccataaaacactatgggctcctgacagcccaaggggagaatggaaactcttgcttacagtggccccactcacccactacgaaatacctcatctcctcatccttagtcctcagcaccaagaaggggtgggcacgtgctctgctgggctgcaggaggcccgactttgctccacagatgctgctgagtgaaggagaaacagcacaacatgggggaagagtcctaaatgcttcatgtgtgctgagacctgtcctttaggaacaggcttgacatataatgagccatctgcagaacctttctaaagagagtgtaaagccagcccctcctacccctacaggactttttttgtttgtttggtgttgaatgctttttgctgtaaaacagagcaatgcaagagtttagaatgaggttagagcatttcttcacactttaaaaagcatagctgagggttgcagagacaggggctgtgagtcaggctgggttgggatcagaccttggctccctgacctgctcaccactcaggtctcctctctgagctttagtgcctcatctttaacccataccctgtttgctccaagaatactcttgtctctaattctaatgtaacatcaagtacatttctgttacattaggattagagacaagttctgtttagaaataactccaagaacagtttttatattttattttcacaatgaaaatcagtcagatttgcttcaacctcaaagagcatgtttgtgtaaaattaaatgagctctggcagtgagctgcactgttttttttctttctaagtgggttaaaagaggcaacaagtggctcctccttcctagaactggttatgaggagactctggcacagctgctgctccctgcttccctccctgcctccctcctttctcatccagggatcaattaggctgataatatggcaaagaggagtgagcacttcactaggaagtagcagattggggtcacacctgagccacttactcgatgtgattgcctagggtgggaatgcatcaactgggaacttgcgtctttatctgtaataactgcaaaatcaggataaagcccccttctccatctatgtttaagggttgttaggagtctcgattgctaatgatctaggaaggaaattaggcagtgttcttacatatgaaaacacacacaccctctgacctagcaatgccacctccagtgggcatttgtcacctgagtaggataacacatgtacaaggtcacccactgcagggttcttttaatagttcaacattgggagcaacttacatatttatcaacagaatactgtaaaacaaatttgatattttcataaattggactattctgcagctgtcaaagagtggaacagctctctatgtcctgacgtggaatctcaataaggaatgatagggtttatgtttggaagagtttttccaatcaccaatgggctttagtgtctgaatgtgaggtgcattctgagcctttgggaaaccgatgaaaaggagaattgctggctcttcggtcagtggttttgtttaaggagcttttatttagctcctcgaacatagtccgtgttgtttctctttgtctagtctgaaatagttgttacctggggaaagtagccttctcttggactgtagattaattcgtggcctggtccagctcctctgaaccactggacaggccccacagggaacagggaggtcgcagtgcagtgcagagtggacatctctccagctgcgactgacatgaacttctcaggctgaatcacctgcaactcctcctcagctttcactttcatgacaaagcagtcatttattcatccttacatgatcctgtgtgtttcctcatgtgtatcaaagactttcattgatcgagtgcatatcaggagcagagcttgagctcagcacattgcatatattatctcatttaaccttcacaacaagcctgtagcttgttgtgacatgagactgtattagaagtgaggacaatgaggcgcagagaggttcaattttaagatagagcttaaacatgagactgtattagaacatgagactgtattagaagtgaggacaatgaggcacagagaggttcaattttaagatagagctttgggttgaggacctgaatggagctcctgagccctctttggaagtgtcatactttgctaaatatttttgccttcactttctggccatatggagtattgcaatttctggaccatttcattgactgaggtcatgtaactgctttagaccattgagtcatgagtagaaatgatgagcataatacgtggactgtgcattcaaatgcaagaacctctatggatcaccttctcccttccgcagagacccacaaggctctgatggagtctgctccatcagcctggattcctgagtgacagtgacatgcagaatccccaacacaccatgaagatgcagcttaaaaagaaataacattgttttaagcccctgggaatttttcacccatagcataagtttcctaatgctgatacgactaattaccaaaacttggtgtgttacaacaaaagaaatgtatcatattgtagttctggaattcagaagcccaaaattgtgtgactgcgttacaatcaagaagaaaagtcaagtatgtaaaggtgaagaataaaatggtactgaccagggtgaagtgcagggaggtaatggtgagatacaggtcaaaaaatacaaaattgaagataggtcagatgaggaagtccagagatcgaacatgccatatatcgacaactagagttaacaatattgtattgaatttagtatttttgcttaaagagtatatttcatgggctcttgacacacacccacatgcagagtaactgtgagatgatggatatgttcatttgcttgactataataatcattacactatgtatatgtataggaaagcatcatgtggtacaccttacatatatacaatttttttaaaaaacagctatgttttctggagtctctgttctttgcctttactaattctggaagctggtaacatttcttttctcatagttacgtcttcccatcactccagcctctggcttgcatcctcacatgtgcttctctaactcctaatttcctgcctcctccttcttataaggactcatgtgatacactgtgggcccaccctgatgctagaccaagatgttaaaaccactgtcttcaacacgttcaaagagctaaaggaaacaatagacaaacaactaaaataattcaggattatgatacagtaacaaaataagaactgtaacaaagagaaattataaaaagaaatcaaacgagaactttagagttgaaagtattacaactaaaagttcattaaagaggttctctaacaagtgagcaggtgggaaaaaaatcaagaaactggaagatgaaatcattgaaattattgacagtgaggtatagatacaacaaaaatgaaagataatagaatctaagggaatgatgatacattatcaaatcgataaaaatacacattactagagttctgggggaaaagagaaaaagagaaaggggcagaagattattggaagaaatcatgaacaaaatcttcccaaacttgataaaatacatgaatctacaagcttaaggtgccaaggaaacccaaatttaactcagcgataaagtcaaagagacccacattaagacacattataatccaactgtcgacaattaaagtcaaggaaagaattctgaaagcagcaaaagagaagcgattcctctcacgcgagagatccttgtaagattatcagctgagttcttatcagaagcattggaggccacaagacagaggaatgatatgtttaaaatgctgaaagaggaaaaacctatcaaccaagaactctacacctggcaaacatccttcaaacacaagggagaaattaagatattctcagataaatcctcagccatggatccttgcgtgaatagcacgatgtctccaggcccaaacttccctgatctgtagaaggggtggcatcaggtcatgaaaatgagcacccaccaccacacccaactggtgtggtgagagtttatgaccactaaaccttacctacaaaaacgctaaaaggagtgctttgggtggaaatgaaaggatgctacatggcactcaaaattgtatgaggaaataaagatgtccagttaggtgtacatttaaaaaattcatattttcctgatgcctcaacatccctgaaacaagctgtgagcaccctaccaaatgaccaggtacagcagtgtgataaagctggtccctgccacaattcccctttttgtcctcctctgctgtgacctagtagagtagtggcattaaaacataccagtgaatccatcatggtttttgtgtcctccaccctaactcccagtaagacacttgcctggggttccaatctgtcttgcttccccatctgcttggttgagcctgcttcacggaagctccttccatatggcttcctacctggcatgccataccccactctctgggaactatgagtagaataaattgttcatcttcatatgtctctccaaatgaaattttcacagtcatgttagagtgttctttatagacccaatcagcaggacttactctaccattttcaacactaatggcaatgagaatgggatcattctaaactagggtggaaagttcctaggagattccctttgaatgctcatggcttgctaatttgctactctgattggctcaaccatttgggagatgctattaccctgatggctttcttgtactctgctttcttcagctttgtgttgccttttgggagtgttaccaagactctccatcctaaagtggggatcatgtctcaatatcaataatggcatccacctttcttcaggagcacagagatgacattacattgataacaacatctttaaaacagattcatttgacacacgtattaatgtcatataatccaacacctttaagtttctgttaaatgctagtggcaacatattcttttacacatcatcgaaaacaatactcttgttagtgccttcaaacaaacggacaaacaaacaaaaatacctcttctctataaaaattttgccaacttctttcatgcctgttggagtctcttcaccactcatgttggccatgaatttccccagggcttttgatgcagaaacaatgcccctcttggcctcatcctatattccattaaaacaacaaatgactggttacctactgggatcccctggtctggagtacagttctacaaggcatactttcctgttgcaatcattaaccataaattgtcccacatccaggctttgctcacctgatatgaagcgcattggaaactaagcttccactagaacacaaaattaaaatcactgccaggtccagctgcacaccattctgttgacagttggcattattactgctaggtttgttaatgcaaaaatactcaaccaaatactagcaaactgaattgaatagcatagtagaaggataatacaccatgagcagataatagttattcctgaaatccaaggatgtttcagtaaacaaatgacaacaatgtaatgtaccatatttatggaataaagggaaaaacacatgattatccatttgatgcagaaaagcctttgacaaatgtggctatctttctatgacaaaaataatcaataaaaggaatatatgaaaacattcaaaattataagtcatatactcatactttcttgtttttttggcactatctaatttactattcactgtctaatttactattttatttacctccttatcatgggtattggttactgtcattctccagtggatataaggaacaaaagggaaactactttttctattttattcaccagtgcacccaacatttctatgtcaggtcctggaacatagtagatatccaataaatatgtgtataatgtgtgaattgctcagtgggatactttcttaagagactgaaatcttttattttaaatggattgtttctgttgaatttggagaaaataaatttcccatgtagatgagttggtgaagaaaaaatcaatttgcaatcatacagaaagcagaagagcccaggagaagaaaactacacatcctcttcctcataccacacccctgcacacactcatactagcagcagctgcagaaatctcatggaatagaatcagggccagaagtatttgggaagagtaatggtgaaaactgtgatctctagattaagagtgcctgagctcaaatcatagctctgccaattaccaatgaatgaccttggaatgctttgtgcttctgtttccttatctatgtgtgtgtgtggtggggggcagggggtgataagaatctctaccttggatataatgatcatccaaagtaagagctgtaagatgtttccaacagtgtctgccacatggagggtgttcaaaaattataaagttggccaggcacagtggctcaagcctgtaatcccagtactttggaaggctgaggtgggcagatacctgaggtcaggagtttcagaccagcctggccaacatggcaaaaccctgtctctactaaaaataaaaataaaaaaatagctgagggtggtggcacacccctgtggtcccagctattcaggaggcagaaacatggcaatcacttgaacccaggaagcagaggttgcagtgagctgagatcgcaacactgcactccagcctgggtgacagagtgagaccttgactcaaaaaaatgaataaataaataaaataaagtttttactcagtagatttcctgaagcttggaggcttcaatggacattagatgatgaggatataggtatgactatggatatggatataactaatataactatagatatagttactatatagatatagatgctataggccgaagtttctgcaactttatccacttctttcttcctcacacctacccttcatgaaagtgggaacactaatagagtaatgcatggaagttctattttgagggactatgcattttaccaagaggtttgcttatctattgcttatcttaacagattgggggactttgaggggtaagatcagagaagtaaaaaagaagagagagtgtgggcaacagggaaaaccaaatatctctttaatgtgcatttcatatagactaagaaatggttagaaggaaataataagaaaagtcttttaaaaatcctgtgtgtgtttcgcatagtcaagtgagatttatcccaggaatgtaaggatgggtcgatattcagcaatctctccatgtgacacactacataaacagaatgagtgacaaaaaccctatgaccatctcaacacaggccccaaaaatgcatatgaaaaaattcaacatttttaagtgataaaaactgtcaatgaattacatataggatgattgttcctcaacataataaatgccatatgggacaactccataaaaatgaactcacatatttacacttaattgatctttgataaaagtttcaaggacacacaatagggaaaagtcaatctcttcaaaaatgttattgagtaaactggatatccatgtatagagaaataaaattggaacttcatctcataccacatacaaaaatcaactcaaaatggattaaagacttaaatgtaagatctgaaactgtaaagtactagaagaaaagttctgtaacattggtctaggcaatcagtttctagatatcagcccaaaagcacacacaacagaagcaaaaatagacaaattgaattacaacaaactaaaaagcttctacatgtgcatttctcgtggatatagaaatgaatgtgggattacatacatagccaagaaaacaatcaacagagtgaagagacaacatacagaatgggaaaatatatttgcaaattatacatttgataaggagtcaatacacaaaacatataaagaactcaagcaactcaattataaggcaacaactcactcaattaatatatgggccaaagacctgaatagacatttctcaaaagaagacattaaaatggccagcaggcatataaaaaatacccaatcttactattcatcagagaaatgcaaattaaatccatagtgaggtatcatctcacacctgttagaatggttattatcaaaatgaggaaatttaagtagcattggagagtatgtggagaaaagagaatccaacccactgttggtgagaatgtaaattagtacagccattattgaaaacagtatggagtttcctccaaaaattaaaaatagaactatcattagatccagcaatctcacttctgggtgtatatccaaaggaagtaacatcagcatgtcacagcgatatctgcacccatatccattgcagcattatttacagtagcaaaaatggaatcaacctaagtgtctatcaacagatgaatggagaaagaaaatgtggtatatatacacaatgaaattctaatcagccttacaaaagaaggaaattctgtcatttccaacctggaggatactatgctaagtgaaataagccaggcacagaaagacaaataccacatggtctcactcatacactgaatctaaaaaagttgaactcacacaagtagagagtagagcctataatcacagcactttgagaggctgaggcaggtggatcacctgaggtcaggagtttgagaccagcctggccaacatggtgaaaccccgtcactactaaaaatacaaaaaattagccgggcatggtggcggacatctgtaatcccagctactcgggaggctgaagcaggagaatcacttgaacccaggtggtggaggctgcagtgagccgagatctcaccattgcactccagcctggacaacaagggtgaaacaccgtctcaaaaaaaaaaaagaagtagagactagagtggtggttaccaggggcaggggagggggtgtagttgggagatactggtcaaaggatacaacattttagtttagataagagaaataagtttaagagatgtattgtacgatatgatttctagagtgaataacatgaattgtattgttgaaaattgctaagagagcagagtttataagttctcaccacaaaaagtgatatacatgtaaggtaatgcataggttaattagctcaaattaatcatgtacacatattttataatatgttgtacatgataagtatatatgcttttctcaaacaaaaataaaatacatttcttttctgagacatttcattgcaaataaaaagataacaataaatgtgaaatcttatgtacatgtatgtacacttatagtcacttatacacacatatatatatgtatacatatatacacatgcattcacaaatatatataaaagtttgttctgtccttatactatataaagatgttttgtgcattaaataaaattatgaaacctgttaaaatctcagtaaaatatttggcacataaaagtcatccaacacatttgtaacaaatgttgggagtatatacaccagcgttttaactctgagtgtcacttctctgactggtgtgatgggtgatgattattcctatgtttacttccctgcatgtgctaatatttctacaagtagcataacatggctaaaagaatgaactctggagttggtccacctggacttgaatcccagctgctccactgactgaggtaggggacaatggacaagctcctccctctgcctgactccttgttttcaaataggagttaataggtgtagctttcaaatagggatgttgtgaggattagtagagttaagtagagttaaaatacacaaattactaagaactgtgtctaccttgtaggaagagctcaattgctgaactcttaccactgtcatttgggtaaagtgtatatgtaagaaagataatttgaaaagtgagaaccttgtcctctaggacctgtgaggtgactcacagcaggggccagtggggagcagggaggctgctgtgcccagccctgtgattctggggtcagctccctggcctgagtagggtgtgaggacaggcagcctgtctgtgggctgtgagcagggctctcccaggctgcaccaggaaaggtcttccaatcctgcctgtcctggggaagggaaaataaattctccatggtaaagtcgaaagaaccaaggtagattgtggtacttgttatgggctgaatgtgtcccccaaaatgcatgtgttgaagccccagtccccagaacctcagaatttgactgtatttggagacagggtctttaagaagctatttagttacatgaggtcattgggggggtcttaatctaatatgactggcgatctcagaagaagaggagatgaggacacagacacacactgagggaagaacacgtaataagacacagagcagagacggccatctacgagccagtaagaaagacctcagtacagactaaccctgccaacaccttgatcttgcattcagcctccaaaagtgcaaggaagtaaatgtctgtaattttagctgcccagtctgtagtactttgttatgcaagccctaggaaaggattacagggcccagaaagcagcaaattccttcttaaagaggaagagggcacaaaaaaatgggtggtaacactgagattacagaggagtgggaagcagggggaacagagggcaaagtatgcagcatcctgaagaaggacagtggctgaacatccccgggaaacattgctcccctgcccaactcaggcactgtttcagacttcacatcctcagggtgctgaacagagggctgagcctggagccacacaccctgtcaggctgtctctcagctcactctgtggccttgggcagatggttttgcctcctggagcctcaaggctccagcctcaaggctcctgctcctcagtttggggcagcagaagggttcccaaaacctactgctcaatatttgacaggaaccaggtctgcttctggtaaggatttaaataatgattcttctgtgtttgtcaaatgaaatattatttttaaaatgtaactaattatggtgctggttgaaggatcacctgattccatcccttggtagccagctgcagatccacagagaaagtgctcagctccctgatcttctgctctcagacaatgcccagtccttgacctaccttgggagcacttgtgtttgtctggaatccctgaaagcccaggggcagggatttcagggctgcaagcagagagaaagggttctagcccaaggcagtgctcacctgtgcatccccgcagcagaatcagcagcaggaaaggaccaggagggtggggccaggaggctgggatgggtatcctgaagacctcaggagcctgctccgtccaaatatctgtgctggggagatgtcaaacttctctgaggagagaagacaagcactgtctcccttgattcaagaggaagtggcaatgatagagtacaacagtgaaatagaaatcaggcacagtaggcagttacaacgcaaacagttactcatgctccattctcaggagaatcagacaggcttagcagaaatagtgcttcctgcacaccttgaccatatgttctctccacatggcccctaacaccatcttcaggtcttcttggtgattcaccatttggggctgttagttcaagaaggacctgtgattaagaactgttttctaaacttcccatctcaagaccctaggatgttgctggcttgttttcttcttctgcaccaggcctcaaccaagtgctactcagttcggggcaggaggagggttcacaaaagctactgccaatatttgagaggaaccaggtgtgcttctgaaattgttccctattccaaacttttatcaatgtaactggcaaaacttagcccaaattcagtctaatctgggaccttagcagcactttcatgtgtctgcatccagcagaaggaatcatctcctgacttcctccaggagaggaaatgggtttaggttaataaggatatgctttgtgggctgaggtgggaattatggttatgggttatggagaggggatagggttatgatggggggagaatatggtatgcaatttcctggggcagtcacatcaatagtctttgttttgcacacagaacacctattccatccaccactgcatttagattggaggtgaggagagaggaagaataaatactccaaccaagaggatgtgttaaggatttgaggaagtcactgggccctcctaggctcagttttgttctccaaattgcaaataataggtttttcactgctgtgtttttgtggatgttaaaagagatcatgactgtaccatacctgaaacccagtaggtcattattgataccatggtgccaggtgaagagaaggaactcaaaattttttgaatggatccctactgcaggctgagtttcccaccagtggctttctccgagatttccaggcccctgagacccagcttatatggtgtacttgaaatatccctgccactctgagatcagttgcttcctctggatcctctgcaccctgcttcttgtcaatgcataaatgaattcctctctcacaatatcgagctgtgtgactttaaacaagacacctaagttctctgagccttagcttgattatatgtaaatagaggttataacatgtaccttgtaaaggtatggtaggaataatataaaccgtaccgaatgctcaactcataattaattataactaaaaaatggtggctatattaatatgttgtgtacagcaagcattcactgcttccctgtgacacttgtgctttagaaaaattaccctgttaggagaaatggtttctccttcatcatctatgactaagaaaggcctgtgtggaaccctccctgtcacatgctgggtttgaagtccttcatctctcagaagtaattgtcaaatgaaattataaaaattatcatatttccatccaaatttctttttctatgtggcagatgtacagagagtgaaatcttcacctcctgctccatacccacagaaacgaatataaaaaatgataaaattaccttaatcaatgtctacactttaaaacaagaaagtagtctctatatgccatgaaggaatagtagaaactattattttttgcagatgtcctggacaccagacatggtatccggcattttatgtcagttacctcattaattcaacactctgaccctgaggtaagtgctaccattaaccttcatgtaaaggtgagaaaatctgaagcacacagagagtagcaagtttgctcaagatcactcagcttttggattgagacataggctgtcacactgcacagccttcacttttaatgtttgcactatgaccacctctcataagacaggagggacatccctctagaagtaagcagtgaagaagccacagactcagttaggagcagcccccacagtgaggctggggcaggtgccatgcttcacgagcccctgacaacccaagatcacatggggcattattcctgcaaagacggcagtgcaagcagaaatcactaaagatttggggaacagcagcaccacaagtgatagctaaccaatccaagaacaacaataacttaaaaacaataaaacagtaataaaaagaacttcacacctgagaacacgttaaaaaataaaatatgagaaggtgttcaagattagaatatttaataacctataaacataacaaaaaaagcaaatccataaaacaaaaccaaccatgtataaaacaagaataggtagacatggagtacaacaggtatctcggcaatgtaacaaagcagaggattttaaatatatatataggtttttaaaaataactaggttgacatattagtttgttcttgcattgctatacagaaatacctgagactgggtgatctataaagaacaggggtttaatcggctcgctgttccacaggctctgcagaaagcatgatgcttgtaccttcttggcttcagaggaagtctcaggaaacttacaaacatggcagaaggcgaaggggaagtaggctcatcttacatggtcacagcaggagggacagggagagtagggaggtatcacacacttttaaacaaccagatctcatgagaacttgcttactatcatgagaacagcaccaagagggaaatccacacccaagatccaatcacctcccaccaggcccacctccaacattggagattacaattctacatgagatttggtggggatacagatccaaaccatatcagctgagtaagctgactatacataaatgagtagtaagtagtgagctgggtcatcacgtaggggccatctcctaggacccagcacaaagagacacatccaaacaaagtaatgtaaacatgtataaatatagcaataacaaagaaataccataacatactttgcaaaattttgtgctagaaatattaatatcttaagaagtataatttaaggcaaaaagcacaaatggttgaaagaggaatatttccttttatgaaagtaacaactacccggaagatatgagtcacaaaatattatacctccaaaactataatttggaatatatgactcaaatattgatagaatagtttcaataatttggcagaatctgtacttggagcagcaaagtgacttcctgtgaactccagtccttcaataaagatctattagatgcatagatgctatgtgagtgaaaaaattttgtggaaatcacgtggagaattgagtttcaaatttaagttgacttcgtgcagtacagttacagcctgaatgtttgagagaagcaggagcctgggaaaccataagctaaaattctccttctgcgaaatttagccctgcactcatgacacaaggtgcagataatgagatatggctgtgggaaaagggaggagtcagtggatgtttgagaagagcacagtttaaacttgtgggcttaggaatcagaacttctaggtttgaatttagttctaccagtcctggctgtgtgacctaggggtatttgtttaacatctctgtttcttcagttccctaaaatggaaataatagtcatatcaacttcataggtttgttaaggccgtaaaatggattaatatatgcaaattacttaataacagctgaccgtgttccaaaagttagatatgatttttattaggtggtattttggtaatagtaatagttttaaaaaacagactctctgccctcaaggatttacgatgcagtgcaacaaccctggccaatggctgggggatgtgcaggtaccaccacatgatgagtgtgggtcatgtgtccagccttataatcacaaagtcattactagcaccagggtcgtggtgtgggcttggcctcagggggaatcactatgactagggcaaggcacatcccagtaagtgtctacacagatgtttatggaaaaggagctccaagtcttgtctcatgcagggatgggagagaagaaagtgctcccagagaatgtgacacaggcaaaaatcttcacatgaaaggaacttttgcagagatttcaccactttgaaagtacaaaggggaagagctggcaagatggtcgaataggagcagtgccagtctgcagctcccagtgagaccaacagagaaggtgggtgatttctgcatttccaactgaggtacccagctcatctcactgggacgggttagacagtgggtgtggcccacggagggtaagcagaagcagggtggggcgtcacctcacctgggaagtacaaggttttggggaactccctaccctagccaagggaagccgtgatggactatgctgtgagggacagtgctatctggtccagatactatgcttttcccatggtttttgcaacctgaagaccaggagattcccttgggtgcctagaccaccagggccctgggtttcaagtacaaaactgggcggccacttgggcagacacagagctagctccaggaatttttttttttgtaccccagtggcacctgaaatgacagtgagactggaaagggggctgaagtcagggagccaagtggtttagctcagtggatcccacccccatggagcccagcaagcaaagatccactggcttgaaattcgtgctgccagcacagcagactaaggttgacctaggatgctcaagcttggttggcggaggggcatctgccattactgaggcttgagtaggtggccaccaggaagttcgaactgggcagaacccaccacagtgcagcaaagccactgtacccagactgcctctctagattcctcctctcttggcagggcatctctgaaagaaaggcagcagcctcagtcaggggcttatagataaaactcacatctccctgggaaagagcacctgaaggaagttgtggctgtggttgcagcttcaggagactcaaagttttctgcctgccagctctgaagagaccagcggatctcccagcacagcactgctctgataaggggctgactgcctcctgaagtgggtccctgacccccatgcctcctgactgggagatacctcagaaataacaccacacatgtacaccatctgatctttgacaaacctaacaaaaacaagcaatggggaaaggattccctatttaataaatggtgttgtgaaaactggttagctatatacaaaaaactgaacctggaccccttccttacaccttatacaaaaattaactcaggatggattaaagacttaaatgtaagatctaaaaccataaaaaccctagaagaaaacctaggcaataccattcaggacatagtcatgggcaaagacgtcataactaaaacaccaaagcaattgcaacaaaagccaaaattgacaaatggaatctaattaaactaaagaacttctgcacagcaaaagaaactatcatcagagtgaacaggtaacctacagaattggagaaaatttttgcaatctatccatgtgacaaagggctgatatccagaatctataaggaacttaaacaaatttacaagaaacaaacaaacaaccccaccaaaagtgggaaaggatatgaacagacgcttctcaaaagaagacatttatgcagccaacaaacatatgaaaaaaagctcatcatcactggtcattagagaaatgcaaatgaaaaccacaatgagataccatctcacgctagttagaatggcgatcattaaaaagtcaggaaacaacagatgctggagagcatgtggagaaatagaaatgcttttacactgttggtgggaatgtaaattagttcaaccattgtggaagatagtgtggtgattcctcagggatctagaactagaaataccatttgacccagcaatcccattactgggtatatacccaaaggattataaatcatgctactataaagacacatacacgtatgtttattgcagcactattcacaataacaaagacttggaaccaacccaaatgcccatcaatgatagactggataaagaaaatgtggcacatatacacaatcaaatactatgcagccataagaaagaatgagttcatgtcctttgcacggacatgagtgatgctggaaaccatcattctcagcaaactaacacaggaacagagaaccaaacaccgcatgttctcatttataagtgggagttgaacaatgagaacacatgtatgcagggaggggatcattacacaccggggcctgttggggggtgggggggcaaggggaggaatagcattaggagaaatacataatgtagatgatgggttgatgggtgcagcaaaccaccatggcacatgtatgcctatgtaacaaacctgcacattctgcacatgtatcctagaacttaaagtataatttaaaaaacaaacaaacaaacaaattgcaaaggataagatgttggaaacaaattcaaaattaggaagatgatgaaacaccaaggtagaaacaatgcttgctccatatcagaaatgcacaagaaggtggcaagcactgatccaactactcttgatacatttttacaaatcaataaaacacttgaactctcaatgtttctaatgctttgaattacagtgcactaataaatgtttatttcattacatttttattgcctcctacgtttgtaactttgtttctaatattttgacaaaaaattgtaaaagtcacagaatgatcattgtttttccaattggatatggagattgctttcccaggtttcaggttgcacggtcatttttacaatcctgcattgccatgaaaagtgagaactgcctgtattcagaataatacagatggtaatatgtgctaaggaaaaattcatcatgttaagataaattagagtatcagggtagggagggaaattgatattttatacagggtggtttacattagtagacattaggcagaaagagttgaaggagggatgaagggaaccatgtagctgtgttggagaagaagcagaggagtatacaactagacttttccaaagaatcactgtggctgaaaactgaaagccagtagaggcaattggaatgctaccagaagagatgatgctggctgcgacagggaagggtggtggaggtgagaaatgcatgaattaggcatgtaactcagtgctgtgctggagcagctgagagccaattgttaaattttaggaattttgcaatctggttgtttaactgttgatggcttgaaactgtctatgttgggaattttcatactacagagattggcaagcactacaaatcagctttttgtttttccctttcagaaagtccattgttaaacatttactgtctcatataagtggacataagcatttcaaaggcagaattgaatgcagagtataaaaaaaagagagtgagaaatcaaggaggactccaggatgttggactgtggcagcatttctgccacgagcagcagggctgggaaggctgcaggatgctagcagaactagtgtcccatcacagagaaagcagggagagcttctttctttcttggtgtgagacaaagaggaaggagaatcattttttcttaaaattgggatgggggttcatttgtattcaggaggcaatagtgaacctcaacaaggctgggaagttggagtaggcaggaatccagatggcagaataactcttgaggggctagagagagtctgtggtttatggccagtcccaaggcgatggatgcaaggagtcctaatgtgtttagatttggcgtgtttcccacatcctagggaggtgtcgtgagtcactccccagagccccatcccatggcctctgctcaggaccatgaatgaagaccctgctatggagcatcaaggactctgcaaaggagcaacaggagcctgtgggcaggaagatgtcctgggaggacaggcatttggagctgagtctggggaagcttctcgccagctccttctctccagctgagcccttcaaggaaggaaggaggcagcacagactgagggtcccacatggcaggggaggaggaaaggagctgtgggaaacacatccacatttagtcatctgctcatccttcaagaaatgattcctgagactctgctatgtcctcagtgctggtcttcctcttgggatgcctattatgggtggacagggagccctgagatagaatttcacctgctcagccctcctcccaagtcctgatgccctttccctcatccctcccactcaggcgctgagagcctgagagcactaagagcagcccacttgaggcgtctcaacagtactctacagtggggattccttagatgccacggagtacagcatcaaataattgagagatggcctgcaagggaccacctacagagttggccctcattcagccccctctccccacctcccctatgggcccctagggtgctgtggacacctttgaacacccttatggtagcccacctcctgcagcacccacacacttcctggggttgggattctcctagagggttccctgagacttctgagggtgctgaggaagccccatcaccttctccaaactccactgaccctgaggctgtgtggcatgcgggctgggtgctcctgctggcctgaccttctggagcagcccttggcccaccctccctcctctacacttacagtcaggccttctgcttccggtggacataggcagcagagacatcaaccagcagcagcaccttggagcccaggaggagacctaggaggagtgaggcagtaggagctggcacccggactggaaatcaggagacaggaggatccattagaggggccacctgggaggccatcccaggggcctccacttaccccatctgaggctacctgggctgttcagttctccaaagcaagagttcagaatgagaagtttggagggattctctatagtttaacaagtgcgctgggtgttgcagagacaggggctatcaatcaggcttgtgggattcaaaccttggatccctgacctgttcaccactcaggttccctctctgagcctcaatgtcttcatctgtaaaagggacagcaaatggctccgacttcgtagcactggttaaaaggagaaaatgccaggatgacggtacagtctctgacacaaccgctgctccttggccccctcccacctccctcttctttcatccaagtggtcacttaggccaatagcatggcaaagaggagtgagaaccctactaggagttagcagatctcagttaaacctgagtcacttgctagctgtcattgttccaggtatgagatgcaccacctgggaattttagtgtctttgtctgtaatatttgcaaattaggataaagccacattcctacctatgttcaagggttctggggagccttgattgctgtttcatctaggagggaaattaggcaacatccatttaaattaaaacacatacactctctgacctaacaatgcaacttctggcaggcatctgccaccagagtaggataacatatgtgcaggttcacccacagcagaattgtttcaaaagctcaaggttgggaaccacttacatatccatcaacagaagtctgcaaaataacatttgatatttccataaattgacatattctgcagctggtaaacaatggagcaggtctctatgtccttatatggaatctcaataagaaattatatggcttgcatttgggagaggttttccaatcaccaacagagcacagagaatgaaggagagaggcgttctaaacctttgagtaactatgaaaaggagaaatactggcttcctactcggttcttttcaaggagctttcattcagcacctactacgaaccagactcttctatggagagagtatctaatgccaggatggaacgaagcctgcctggagtaggatctgggctcttgccccaaccctaactggccctgtgaccttgggcaaggcccctgtcatttcttggcttcagtctcccatctgtaaaagggcattgggctaaatggtctgaaggtcctttttgcactgatattccaggattcaggagttaaattgaggaacctgggcctctgaaagaaaacccaaaataagcattctgctgccttaactgggggacccctaagtcacccatatagaggacctcttctcttaggcgagggacattctgagatggcctagctctgcttgaaacctttagtgactgtgtgaggcagtccctgaatcacacaagggtttcctgaacaacccacaaacatcctggatagacccataaagctcttgccgtctcctttcaccacggccatcagattaaacagtgaatctgtgtccttcaggaatcttcccagtgtgatggttctgaagattatataaagaaaaacccaatttactccctcagtgctctggatggatttatcctcattagaagggaacagaatgtaagcttggtgaaagcagagcttgtgcctttttttttttttaacaactatttgcccagcaaccacggtggagactcacacacagtaggttctcgatgaatgcttgttacgtaaagaagagactcagccaccctggggggaaagtgctctgtggacgcagcaggcaaggtctagccttgtgcctgggaaaatcactcaaaccatcagctcccttatctgtggaaacatggctgggccagattagaagaggcaaaggctatggtgccaggcagactaaggtttcagacttccccatcatttaccagtcacggagacttgagtgaatagcatgacatctccaggcctcaatatacctgatttgtagaagagggtggcatcagatcatgaaagtgagcacccactgccacccttgattgttgctgacagaggacagtgctattattgacttcttgtcataccttgggggatgaaggaggcctacactgtactcaccacgcacagacatctgagtccctggtccagacttaatctccacgttggcaggaattgctctccggagcttcatacagtagtaggtgccagcatcttcgagggtgatgctactgatgcggatggaatagtctgtgctgtttctctttctctggtctgaaatagttgttacccggggagagtggcatctttttggactatagattaatttctggcctggacaagctcctctgaaccactggatgggtcccacagggagcagggaggtcacagtgcagttcagagtggccatctctccagctgcaactgacacaaatgcctcaggctgaatcacctgcagctcctcacctgccactcctagaaagtaacagagcagtcatttactcatccttacgtgatcttgaatgtttcctcaagtgtgtatcaatgaacttcaatgactgggtgcataccaggagcaggccttgagctcagcacactgtgtgtattatctcatttaaccctcacaacaagtctgtaacatgagactgtattataagtgaggacactgagacacagagaggttcagtttcatggaagagcatggggttgctaacctgagtggagctcctgatccccccttggaagtgtcatgctttgctaaatatttgtgcctccactttctggccatatggaatgttgcactttcttttttttttttttttttttgagacggagtttcgctcttgttgcccaggctggagtgcaatggcatgatctcggctcaccacaacctccgcctcctgggttcaggggattctcctgcctcagcctcccgagtagctgggattacgggcatgcgccaccatgcctggctacttttgtgtttttaatagagacggggtttctccatgttggtcaggctggtctcaaactcccgacctcagttgatctgcctgccttggcctcccaaagtgctgagattacaggtgtgagccaccgcgcctggccagactttctgaatcattgcattgggtggagccatgtgactcctttaggccactgagttgtgagcagaaatgatgggtataatttgtgggctgtgcatttaactgcaagagcctctgtggattaacttctcccttccacagagacctacgaggctctgatgaggtctgctccatcagcctggatgcctgaatgaccatgaattctccacacacactgaacatgcagcttaactaacaagtacaacattgttttaagcccctgagaatttctcacccatagcataattacattaccttagtttcctaatgttgatgtgacaaattatcagaacttagcatcttaaaacaaaagaaacgtatcatcttatagttctggaggtcagaagtccaaaatcatgttactggacagaatcaaggagaaaaatcttcagatatacaaagatagaggatgacatgttggtggccaggagtgaagtcggagaggtaatggggagatgcaggccaaaagatacaaaactgcagaaaggtaggatgaagaagtccagagatctaatgtgcaatatgaggactagagttaatagcattgcattgaattcagtatttttgctcaaagagtctatcttagatgccctacacacacacacacacacacacacacacacacacacacacacacggtaactatgtgagagggtggatatgttcatttgcttgactgtaataaccattacactatgtctatgtatacgaaagcaccatgttttaccccttaaataagaggtgtcagcaaagctgtgtgtattctagaggctctgttccttgctgccacattcctttcctcacagttacatcttcccatcactcccacatcttgcttccattgtcatatgtcctacaaagacccttgtcatatattgggccctttctgacactagaccaagatgttaaatcactgtcttaaacatgctcaaacagctaaagaaaacaacagaaaaaaaactaaagaaacattggaatatgatgcattaataaaataagaacaacagcaagagaaattataaaaaataaacagaaacttaagagttaaacagtacaataattgaaaaatccactagaggtgttctccaactggtgtgagcagtcagaagagagattcagaaaactggaatatggaataattgaaattattgtgactggggaatagaaagaaaaaggaataaagaaaaacaagcagaacccgaggacattgtaggacattatcaaatggatcaacacaaacattgttagagttctagaagaagaaaagaggaagagagaaaggaacagattatttgaagacataataccccaaaaccttttgaaacttgatagaatacatgaatcctcaaatttaagattctgaagaaactcaagtttaactcaaggaaaaattcagagacccacactaagacacattataatccaactgttgaaaactaaagtcagggaaagaatcctgaaagcagcaatagagaatggattcctcacatacaagagttcttcaatgagatgatcagccaatttcttatcagaagcactggaagccagaaggcagaggagtgatatgctgaaaatgctgaaagaggaaaaacctatcaaccaagaatcttatacctgggaaaactatcctctaaacatgagggagaaattaagatattctcagatgaataaaaactaagagagttcactaccattaaaccttacctacaagagtggtttcaggtagaaataaaaggatgctacatggcaactgcaagttgtataaataaaaatgtccaggctgggcatggtagctcatgcctataatcccagcactttggaaggccagggcgggcggatcacgaggtcaggagatcaagaccatcatagccaacatggtgaaaccctgtctctactaaaaaatacaaaagttagctgagcgtggtggtgcatgcctgtaatcccagctactcaggaggctgaggcaggagaatagcttgaaccagggagtcagaggttgcagtgagccgagatcatgtagcttgaaccagggagttggaggttgcagtgagccgagatcgtgccactgcactccagcctggtgacagagtgagactctgtctaaaaaaaaaaaaaaaagtcctgctacatgtaaatttattttagttcatatttttctgatgcttcaacatcccacaatcatgctgtgagtaccctgcccaggtgaccaggtgcaccagtgtgataaggctggctcctggcacaatttccctttcttgccctcccatattgtgacctaatcccataaaaagacaccagtaaatcccatcatgctctttgcttgtaccctctaccctgactcccagtaaaggcacttgctgaggaattctttctctcttgcttccccatctgcttgattgagcctgcttcctaggagctcttctcatatggctttctacgtagcatgccctacttccctctctaggacctgtgagtaaaataaatcatattccacatgcctttccaagtgaaaatttcatgaccatcttagagtgattcataaagacccaatagcctgactttagcattttcaataccaatggcaatgagaatgggatcattctaaactggggtggaaatttcctaggagatgctctttaactattcatggcttactaatttgctactctgattggctccacaacttgagaaggctttttacactgatggctttcttttgctgtgctatgtgcagcttcatgttaccttttggagttctgccaagactctctatcctgaagtgaggatcctgtttaaatatcaataatgacatctacatttcttcaagagcacaggatgacataacattgataacaacctcttcaaaggagattcatgtgatgtgcatattaacatcacattatccagcatctctaagttgttttgaggcgccagtggcaacatattcttcttttacaaagtttatttacaaattaaaatcaataggcacccctgttagtgcctataaacaaagaaacaaaaatacctcttctctgtggagactttagcaatttctttcatgctttttggagtttctagaccattcatgatggccatacatctccccagggcctttgatgcaaaaacaatgcccctctcacccttgtgctatattccattaaaacaacaaatgcctggttacctactgggctctcccatcctggagtccagatctaggaacaatactctcctgttgcaatcatgaaccgtagattgtcccacatgcaaggctctgctcatctgaaatggggcccattggaacctaaacttccactgaaaagcaaaattaaaatttccgtcaggtgcagctgcacaccattttgtggactgttggtcttataatttgttgatgcaacaattctcaaccaaatactaacaaactgaatttaatagcatattagaaggattctacaccatgagtaagtggaatttattcctagaatacaaagatgtttcaatatacaaatgataatgtaatatatcatattacacagtgaagagaaaaagacacgattatctcatttgatgtagaaaagcatttgacaaatttgaacatctttttatgagaaaaataatcaataaaaggaatatatggacatttccacaacatgataaaatcatatactcatactacactattttatttatctacttatcatgtgtattggttattatcatttctccagtagaatataagctccaaaaggtcaaccacttttgctcttttattcaccaatgcatgccatgttctatgtcaggtcctggcacatagtagctatccaatatataggtgtgtaaggtgtgaattactcattagaacacttccctgggacactgaaatctattttaagtggactgcatctgtgatatttgctagaaactgagtttcccatgtagatgacttggtttaaaaaacattcatttgcatacacaaagaaagcagaagagcccagaaggagaaaaccacaaaccctcttcctataccacaaccccactcactcccaggagcagcagctgcaagaagtctcatggcatagcatcaaggccacaagtatttgacaagagtgacggtgaaacctgtgatctctggagtcagagtgcctgagttcgaatcatagctctaccagttaccaatgagcatccacacaactctttgtgcttctgttttcttatctgtgagcagtgggaggaggttaaggggaatatttattctgggcataacaaccatctgaggtaacagctataaggcatttccaacagtgtctagcacatggtgagtattcaaaaattgtaaattattactttttagattttctaagtcatggaggcttcaatcgacattatatgatatgcatatggatacagctattgatataaccatagatgtagataacatagacagcgctctctgttttatccctttctttcttcctcactcttacccttcatgaaagagggaactctaagacagtaatgcacagaagttctgctttaaaataaaactcattttaccaagagagaagttgcttacctattgcttatcttaacagattgggagagtttcagtggtaatatcagatggtagaaaggggaagagagtggctgggcaacagggaaaaccaaacatctcttcaacgtgcatttcatgtagactaaaatatgaatggaagagaatgtctttttaaaatcctgtgtgtttcagcatgattaagtgagatttttctcaggaatacaaggatgcttcaataaacataaatctacaaatgcaatacagtacatcagcagaatgaaggacaaaaaccataggaccatatcaacaatgacaaaaaaagcatatgacaaaatttaacattttttcattgtaaaaatgctcaaaaaattagatgtaaaatgaatgctcctcagtacaatgaaatccatataggacaaatccacagctaacatgatatccagtgaagaaaagtgaaaagctttttctctaagatcaggaacaagacaaggatatcctgtctcactaattctatgcaacatagtatcagaagtcctatccagaataattatcaagagaaagaaatgaaagtcatacaaatcagaaaggaagaatttaaattgttgctgttttcagaagacactatcttatacatagaaaatcctaaaatctctaaaaacaattagatcaaaaaagcaaataaagttgcaaaatagaaacttaacatgcaaaatcagtgcatttctatacacttatgacaaattagcttaaaaagattaatagaataatctcatttaccattgcttcaaaaaactaaaatatctaggagtaaatttaatcaagtaagtgaaagatctgccccctgaaaactatgaatcactgatgaaagaaatagaagacacacaatgacaagatatgtgtgtttagggattggagaattaatactgtttaaatatttcctgaggagatctacaaattcagttcaatcctaaaaaaattccaatgatattttccacagaaattgacagaacaatctgaaattaatattaactacagaaaaccatgaataggtgaagccatcttgagcaaaagaagaaagctggaggcaccagactgccttatttcaaaatctggtacaatgctataataatcaaaatagcatggcattggcataagaagagacacatagatcgatggtacagaatagagagtccagaaacaaacttacatatttttgcttaattgacttttgacaaaactgttagacatacaatgaggaaagaccagtcttcaaaaactggtgttggcaaaactggatgtccacatgtaaaggaataaaattggaccttcatcttatatcacataaaaaaatcaactaaaatggattaaagacataaatgtaagatccaaaactgtaaaagtactagaagaaaagtgccatgacattggtctgggcagttaattttgggatataaacccagaaggacagacaacaaaagcaaaaatagacacatgagattccaacaaactaaacactgtctacacaggcaagaaaacaatcaacagagtgaagagacaacctgtagaatgggagaatatttgcaaaccatacatctgataaaaagtcaatatataaaatatagaaggaagtcaaacaactccatagtgagaaaacaacccaaaatataaaatacaggccaaatatctgaacagacatttctcaaaagaagacattcaaatggctgtaggcatatgaaaaaaatccaacattactattctcctgagaaatgtaaattaaaaccacagtgagatatcatctcacaccagttagaatggctattataaaaacaatgatatttaactagtgttggagagtgtgtgcagagaagaaaactcttgcatactgttggtgagaatgtaaattagttcagccatgatagaaacagtatggcaattcctcaaaaattaaaatagaactactatgatccggccatctcactactgggtatacaatcaatggaaacgaagtcaacatgtcacagaaatatctgcactcccatgttcactgcagcactatttagaatagctgagatatgggatcaatctaagtgtccatcatcaacagacaaactgataaggaaaatacacaatggaattctaatcagccttaccaaagaaggaaatcctgtaatttttgacaacatacataaacttgggggactttatgctaaatgaaaaaagccaggtgcagaaagacaaataccacatgatctcactcatatgtggaatctaaaaaagttgaacacatagaaatagacagtagaatgggtgttaccaggggctagggaggaggtatggctggggagagattggtcaaaggatacaaaatttcagttagataggagaaatatgattaagcgattacctgtacaatatggagtccatatttaataacatccattatactaagagagcagattttatgagttctctccacaaaaaaagatacgtatgtaagatcatgcatatgttaattagctcaatctagtcatttcaaaatgtatacatatttcttaatatgttgtagatatgcataattttgacaaatagaaaataaaactacaattttttgttaaaaatttaatttaaaatagaaagagaaataataaaaaataaaaactcctgtgtgtgtattcttacactcgtatacacaaatgtgtatacacacactcacacatacacacattcataaacacatataaaagcatggcctatcatgctaatatacaaggttgttttgtgcattgaataaaattataacactttttttttttcgagacagtctcactgtccctctgctgcccaggctggagtgcagtggcatgatcttggcttactgtaacctccgcctcctgggttcaaacaattctcgtgcctcagcctcccaagaagctgaggttatagacatgcaccaccatgcacagctaattttttttgtatttttagtagggacagggtttttccatgttggccaggctggtcttgaactcctggcttcaagcaatccacttgcctaggcctcccaaagtgctgggattacaggcatgagccaccctgcccgacctaaattataatacattttaaaagctcagtaaaatatctggcacatagaaagcatccaacacattattaacaaaaggttggagtgcatacaacagggttttaactctggttgtctctgactggtgtgatgggtggtgattgttcctctgttttcctccctgcactttctaatttttctgcaattaacataaactggcttaaagaaggaactctggagctgctccattgactgagctaggagacaatgaacaagttcctccctctgcctgactccccttttgcaagtagaggataacaactgtagctttcacacagtgatattgtgaggattagtcacattaatacaaaatgctaagaaatgtgtctgtcttatcagaagagtttaattggtgaactattatggtagtaatttcactacagtgtatgtgtaagaaaaatacttttaaaagtgggagccctgccctttaggatctgtgaggggacatcacagcagggcccactggggagctgagaaggtactatgcccagccctgtgaccatggggtcagctccatggattgagaaaggggtgaggacaagcagcccggctctcaaaggctgcaccagttaaggccctccagtcctgcctgtcttggggaaggggaaataaaatctccacagaaaagtctagggaaccaaggcatgttatggggacctgttatgggctgaatgtgtcccccacaatgaatgtgttgaagtcccaatccctaatagctcaaaatgtgactgtatttggagataggctctttaggaagtaattcagttaaaggaggtcattgcggacaggccttaacacaatgtgaccctgtgacccatgttttcactacaggaggagctgagggtacagacgcacacagagggaagaccacgtgctaagacacagggaagagatggccttttacagccaaggagagacctcattagaaactaacccagccgggcacggtggctcatgcatgtaaccccagcatttgggaggccgaggtggacggatcatttgaggtcaggagttcgagaccagcttgatctacatagtgaaaccctatctctactaaaatacaaaaattagccgggcatagtggcgggcgcctgtaatcccagcgactcaggaggctgaggcaggagaatcgcttgaacccaggaggtggaggttgcagtgagctgagattgcgccactgcactccagcctgggtagacagagcgagactccctctcaaaacaaacaaacaaacaaacaaacaaacaaaaaccaaaaaccaaaaaaactaacccaactgacaccttgatattggacttcaggctccagaactgcgaggaagtattagccccccagtctgtggtactttgttatggaagccctaacaaatataggacccagcaagcagaagatgtggaacttcttaaaaaggaactggccacagagaaatggtggtaacactcagatcacagaggagggaggaatggggggaacacagggcaaagggaggagcacccttagggaggatggtggatgcaggacatctccaggaaacactgcacccctgcccaactcaagcaggcaccatttcagacttcacttcttcaggatggtgcacagagagggctgggcttggagccacacagccttgtcaggctgtctctgagctcactctgtgggcttccgcgggtttctttgcctctggagcctcaagagttgcaaggatttaaataatgattcttttgaatgtgttgtgtaaactgaactactataaaaatgtaagtaattgttttggtggtggttgaagcatcatgtggtttgatgcctctggtagccagctgcagatccacagaggaagtatgcacctccctgatcttctgctcttagacaatgcccagtccttgactttccttggcagcacttgtggttgtctggaatccctggaagcccaggggaaggccatggctccgtggtgaagaagaaagcattctagcccaaggcaatgctcacctgtgagtcctagcaggagagtcagcagcaggaaaggactaggagggtggggccaggaggctaggatgggtatcctggagacatcaggggcctgctctgttcaaacgtctgtgctggggagatctcaggctctgctctaagtagataagacaagcgctggctccctcgattcaagaggaagtagctgtgatgaagtgagacagtaacctgcttctagattgtgacatagaaaccaggcacagcaggcagctacaaagtagagttctcatgctccattttcaggagaatcagacacacttagcagaaataatgcttcctgcacaccttgaccatgttctctctccccacatcacccctatctccatctcagatatttttggtgattccgcaattgggggttttaggccaagaaagatctgtgattgtgagctatgccctaaactgtccatgtcaagaccgtaagatgtggctggcttgctgccttagtctgcaccagcttcaaacaaacgctactcagctggaggcaggaggaacatttacaggacttgctcagcactggagaggaaccagatctgctcctgaaatgattccttattccaaaagtttgttgatgtaactgcccaaacttagcccaaattcagtctaatctgggaccttagcattttcatgtgcctgcatccagcagaaagaatcatttcacgacttcctccaggagaggaagtgggtttagagtaataaggatctgctttaggaggtaggtggggattatggattccagagatgagacagggttatgatgggaggagaatatggtggacaggttcctggggccatcacctcaatttcagtaccttttgttcgtgaatgaaacacctatttcattcactactgtattcagataagacctgaggagggaggaagaataaatgccccaaccaagagtgtgtgctaaggagttgggcaagctactgggccctcctaggctcagtttcattaaactgtggataataagtttaggataatatctcctaaatgtggataataaggctttccctgcagatgttatggtggagactaaaagagatgttataactataccatgcctgaaacacagtcgggcattattgatactcatggtgccatgtaaacagagggaactcaggtattgcttttgaatggatccttactgcctggcaagttgcagggacttcctcctatctaactccctggtcctcctgggacccagcttacatgaagcacttggactacccctgccatcctgatatcaatggctccctctgggattttcttcatcctgctccctgtcaatccatacattaatccctccacttataatttccaactgtgtggctttcaacaagacactttacttctctgagccttagtttgattgtacgtaaatggaggttataacgtgcaccttgtagagatacggtagaataatataagctatacaaaatgctagacttctacttaattatagccaaaaaactgtggcaacaatttttttgtgtagaagaagcattcactgcttccctgccacagctgtactttagaaaaaccactttattgggagaaatggtttctcttccatcatctatgactaacaaagccctgtccaaaaacatttctgttgcattctgggttttagattcttcatctgtcatgagaaattgtcaaataaaattgtaaaatttatcatattttcattcaaatgtttcaatgtggcagatatgcacatggtgaaatcttcccctgtctgtgattccacactcacagaaaggaaaatgaaaaattatataattatattaatcaatgtctaattacacttatgaacaagaaatgagtctccacataacatgaaggaagagtggccgcatcatttattgaagatgtgttatgctccagatactgcatcaaacatggtatgtcagatctcattaaatcattactccaaccccatgaggtaagtgctaccattaacctccttttacaggtgaggacacctgaggcggatagagagtaatgaatttgctcaagatcacccagctttcagaattagaacatagactgtcacactccacagccttcacttttaatgtttgctctatgacagttctcatagggagggagagtctgttagtctgttctcatactgctataaggacaaacttgagactgggtaatttataaaggaaagaggtttaattgactcacagttctgcagggctggggaggcctcaggaaacttacagtcatggtagaaggggaagcaaacacattgctcttcacatggtggtgcaagaagtgctgagcaaagggagaaaagccccttataaaaccatcagatctcatgagaactcgctcactgtcatgagaacagcatggggtaacagcctccacgattcaattacctctcaccaggtccctcccataacacggagggattatggaaactacaacacaagatgagatttgggtggggacacgggcaaaccgtaccagagagacatctttcaggaagtaagcagagaagaagccatagcctcaattagaagcagccaccacagggaggttggggcaggtgccacgcttcatgagaccctgacaacccctaatcacttggggcgttattcctggaaagatagcagtgcatgcaggaatctccaaagatttggagaacagcagcaccatgagagctagctaaccaatccaagaacaacaataactaaaagcaaaaacagcaataaagagaacttctccacagagaaaacattaaaaaaagtcaatgtgaaaaggtctttaaaattagtatattcaataaccttataaagaaaaccgaagtaaatccataaaacatcaggtatttatgaaacaagaataggcaggcatgaaataacaacaggcatctaaggaaaataccaaaacacagactggaaatgaaaacataattagtgctgaattttttaaattaataggtttagtagctgagatatataaataagtagtaagttggtgagctgggtgatcatgtcagggaaatctccaagcatccagcacaaagagacacacccaaacaaagtaatataaataggtacaaatataggaatagcaaaagatataccacaaaagcttttcaagatggcagattagacgcattgctagcatacttctcccacttggaaggaaaaaatagtgtgtagagagtcacactgagaacttatttccaagaagcgacacagaaactgaataggaaaaccgaaggaatcgacagaccttttgaaggaagcaggaggctgccgcctacactgtgagtcaggcaagggctgcgagtccccagagtgagaggaagggagagactgccttggggatagacacccccaccagggaccctgaaagtccaggcaatgggggaaggctctaactccaaccagcgcaggaaccgacttggggaggcctgtggaatataaaagtaggagcaacggcgggaagacccgtgaatgcacttccagatcctcgtgtggaccgatggaagccattccctactgttccacacaggggactctccggaggacagccgaaaagttcaagcagttggtctcaggttgaaggaagcccccaagggggtttcacaatagaaccttgggtggggatgaactcccttggccaggaccagggcaggggagagtgaaaagtgggctgcaaccgcaagtgcaggagccaggcaccaggctttccagtggatggggagaggcgtggtctgaaagcggctgttattttcacatgggcaactggagttctgagtgcaggctgactggaacttagctcactgctgccagtgtaacactgtgggagtggatctgcctcgccaagtacgtgggaactgtgtgggggcttaccgctgcctgctactcaccattccatgtgcgaacccttctgtgcagcacaggcagcaatactcccctccggaaggtcaacccagtgacctgagacctgctcccatccccacaacacccacaggggctgctgtgtaccctgccagcaaagactcagagggcaaacccgcctgacccagctcccatctggctttgctctgccacttgccctggtagcttcacataaaggacagaaaatcttgagaactatatgcctctcctcattgcctgagaaaccagagtacccgcactgggcaacataaggcaagcaaaaatcctactgctactacagcggctggtgctcttttgcaagcgtcacctcctggctggaagccaaccaacacagtccatgatagcatctcctggtggaatagcactgcgcccaagaaggagaagacagctgtgaaatctccgttatcactactgcctgcaccactctggctaaccaggaggtcctgagcctgtccatatgattagatcattccactctaactggtattcaagaaagtgagtacactaaggctatcaataaacaaggaatctcacagagtctacatcactcacctgctaccaccattagagctagtgctgctacccactgctgggagacttgaggacaggttgtatcaccagatcccttgcagacactccccaacatgagcctggagtgtggcaacttcactggatggctagacccagaggaacaataacacttacagtagcctggctcccagggatccccactcttaggagaagggggagtgcaccacaccaagggaacatcctgtgagacaaaggaatccagacaacaggacttgagcatcagatatttccactggtgggaagttaacagaggcacaattgtagtgctggcctcagcagggaaaatcttcagctctagcccaacagtcagacagccttggtgcccatgaagggctttggataaggaaatatcttttctcccttgtccaccaccacaggcatggttagggcttttcccatgggagttaagtgtgggttaaactatagacgccctttctggaacacgtcagggtgatggcatccccacaggaggagcatcctccaggtgccggcttgcatgagagacagagtcacaattcctctctacttgaacatcaacattcctacccatgaagaggtgcctgtctgatctgaatgctggagtactaggactggagtgtgtctgagaggtgaataaatttcctgctgacctggcaggggagctaaggtggcttcaacccttccttctgataagacctcagtgcaactcactgagagctcctccaagaacctctgtcaaaactgggacctctgcccaccattgggtatcgcatttgcccatctgctgtagccacaactagtccctacccagggacacctcccctattggcccctactacaactagcatgtgggaaagccattatacaaagactttataaccagggaactcttacagtcttcatccctggaagcaccaagaaccaaattaggctgtaactaactataagtattaaagtctcatccttaaggggaaaaagaaattaaaacaaacaacaaacttagtcaaatcaaacataaattcaagaatagttagaagaaatagcctacccaaataagaaggaaccagaatataaactctggtaatatgacaaaatatggttctataatacccccaaaggatcacactagctctacagcaatggatgcaaaccaagatgaaatatttgaaaataccagataaggacttattaagctactcaaggagatatcagagaaaggtgaaaaccatcataaaaaatttttctaagtttaggatatgaatgaaaaattttctagacagatagatatcatcaagaaaaaccaatttgaatttctggaaatgaaagacacacttagggaattacaaaatgcagtagaaacttttaataatacactaaaacaagtagaagaaagaatttcagagcttggagacaaggcttttgaattaattctattaggcaaaaatttttttaaaaagggtcaaaagaaatgaacaaagtctccaagaaatacaggattatgtaaaatggccaaatctaagaataattgatgttcctagggagaaaagaaaataacaaatctggaaaagatatttgagggaataattgaggaaaatatccctggcctggctagagatctagatatccaaatccaagaagctcaaagaacttctgggaaattcattgcaaaaacatcttcaccaaggcatatagtcatcaggctatctaaagccaacatgaaggaaagaattctaagagcagtaagacaaaagtatcaggaaacctacaaaggaaaacctatcaaactaacagcagacttctcagcagacaccttacaagctagaagggattggggtcctctcttcaatctccttaaacagaacaattttcagccaagaattttgtaccctgcaaaactaagtttaataaataaagaagaaataaagtaattttcagacaaacaaatgttcagggaatttgttactaccataccagcactacaataaatgctaaaaggtgttctaaaccttgaaacaaaaacccaatatgcaccaaaatagaatctcttggaagcctaaaactcacagggcctacaaaacaataacacaatgaaaaaaaaattatctaggtaacatttaacatgatgaagagaacagtacctcacttctcaatattaatgttgaatgtaaatggcctaagtgctccacttaaaagatacagaatggcaaaatggataaaaaatcacaatccaaatatctactgtcttcctgagactcacctaacatagagggattcatataaactcaaggtaacatggtggaaaaagatattccacacaaatggaagccaaaagcaagcaggagtagcttttcttatatcagacaaaacagacttcaaagcaacaacagtataaaaggacaaagatggtcactatataattataaaaggatcaatccaacaagaagatattacaatcctaaatttataagcacctaacactagatctcccagattcataaaaccactactaatagatctaagaaatgagacagacagcaacacagtaatagtagaagactttaatataccactgacagcactgggcagatcatcaagacagaaagtcaacagagaaataatggacttaaattacaccctagaacgaatggacttaacagatatttacagaacattctacccccaaactacagaatatacattcttctcatcagcacaaaatagaccatatgctaggtcacaaaacaagtctcaataaatttttaaaaatcaaaatcatatcaagtatcatctcagactacagtggaataaaactagaaattaactccaaaagaagccctccaaactatacaaatacacagaaattaaataatccactcctgaatgataactcggttaatgatgaaatcaagatggaaattaaaaaattatttgaattgaatgataataatgacacaagttatcgaaacctctgggaaacagcaaaagcagtgttaaaaggaaagtttacagcactaaatgcctacatcaaaaagtctgacagagcacaaattgacaacctaatatcatgctccaaggaactaaagaaacaagaccaaactaaacccaaagctagaagaaggaaagaaataacaaagctcagagcagaactaaatgaaattcaaacaacaacaacaaaatacaaaagatcaataaaacaagaagctggttctttgaaaaactaaacaaaatagatagaccattagctggattaaccaagaagagaaaagatgcaaataagaccaattagaaatgaaactggagccattactactgacaccacagaaatacaaaagatcatttgagactactatgaacacctttatgcacataaactagaaaacctagaggaaatggatgaattcctggaaacatacaaccctcctatattaaatccagaagaaatagaaactctgaacagaccgataacaagtagcgagattgaatcggtaatcaaaaaaatggcaaacaaaaaaaaaggtccaggaccagatggattcacaactgaattctatcagacatccaaagaagaattgatatcaatcctgctgaaactatttcaaaagatagagaaagaaggaatcctccctaaatcattctatgaagccagtatcaccctattatcaaaaccagaaaaggacataacaaaaaaaagaaaactacagaccaatttccctgatgaacatagatgcaaaaatccttaacaaaatactagctaaccaaattcaacagcacaacaaaaagatagttcatcatgatcaagtggacttcaacccagggatgcagggatggtttaacatacacaagtcaataaatgtgatacatcacataaacagaattaaaaacaaaagccatatgatcatctctatagatgcagaaaaaggattcaacaaaatccagcattcctttatgataaaaactctcctctcaaaaaactaggcatagaagagtcctacctcaaaaaaataaaagccatagatgagaaacctatgccaatatcctactgaatgggaaaaagttgaaagcattcccccaagaacaagaataaggcagggatgcccactttcactacttctattcaacatagttctggatatcctagccagagaaattaggcaagagaaagaagtaaagagcattcaaatgggaaaagaggaagtcaaactattgctctttgcagatgatatgattatatacctagaaaatcctaaagactcctccaaaagactcctagatttgataaatgaatttgataaagtctcaggttacaaaatcaacgtacacaactcagcagcactgctgcacaccaacaaccaccaaactgagaatcaaatgaagaactcagtcccaaacaactgcaaaataaaatacctaggaaaacaaacaacagttgtaaaataaataaaatacataggaatatacttaaccaagaaagtgaaaaatctctacaacaagaactccaaaacactgctaaaagatatcataggtgacacaaacaaatggaaacacatcccatgctcatggattggaagaatcaatattaaggaaatgagcataatgcccaaagcaatctacaaattcaatgcaattcccataaaaatgctaggagcatttttcacagaattagaaaaaacaatcctaaaattcatatggaacaaaaaaaaagagcctgcatagccaaagcaatactaagcaaaaagaacagacctgaaggcatcacattaccagacttcaaattatactacaaggctatagttaccaaaatagcatggtactagtataaaagtaggcacatagaccaatggaacagaataaagaaccaagaaatagagcccaatatgtgcagccaattgatcttcaacaaaacatgcaaaaatataagttggggaatggacaccctatttaataagtggtgccgggaaaactggcaagctacatgtagaagaatgaaactggattctcatctctcacttcatacaaaaatcaattcaagatgaatcaacgacttaaatataaacctagaactataaaaattctggaagacaaggttggaaaaactcttctaggcatcagcctcagcaaagaattcatgactaagccccaaaagcaaatgcaacaaaaacaaaaatgaataaatgggacctaattaaactaaaaagcttctgaacagcaaaataaataatcagcagagtaaacaaacaacacatacagttggagaagatattcccaagtcaagttacaattgactggtaaggataccgaggcccacgatggtggagtgccttgtcccagatcacagagctgggaaatgtcagagctgagatgtggcacaggtgatggggctccaacccatgctctcctaaccactgtgctactgacactcagtaataaccctaacaccatcaccatccagaactctgtgcacatcctctccaatccccacagagtccataatggtgaccatgatcatcaccatttcacaaatgggaaaactgaggactcgagggtagccaagactttaccaagatcacacaaccttgggaaaacaaccccatcatttactggtctattctctccccagattagctgtatcctcttaacatcctggaatgattggtgtaattatctacaccctacatatgaagaaacaggctcagcaaagggaactgggttgcctgagatcacacagccttgaaataacacgtgatttgggagagtgcctacaatgtgttaggtgatttacagagagaatcttaagtcctttccactctcctaaaggagtccaagattgtcatgattttacagatgagaaaactgagactaagagagatgaaggcactgtcttcttatcccccgtgcatgacttgggcatttcctgtgttttgccaagcttccctgttcatcaaagagtaagcactagaacttcaacatccccaacaatgactgccacctcccttgtccctttcagattcttgacttaatgcaattctagggagaagtctcccttctgggtgcccagggctggttactctgtagttctccccttgggctccctatggttactctgtacccataaacagaagaccttgggttcctaatagcccaaaaaagaatgtaaactcttgctcacacggggcatgagaactctaggaaatgtctcattcccacatccttagtcttcggcaccatgagtgggtgggcacgttgtaatggcccaagtggctcaccttgcccattgcctagacagagtcgatttatgaagacaggggaattgcttgaaagagtaattcacacaattctggctttgcgggagaccagagatttattattactcaaatcagtctctccgagcatttggggagcagagtttttaagggtaagttggtgggtaaggagaagccagtgagccaggagttctgattggtcagggatgaaaccatagggagtcgaagctgtcttcctgagctgagtcagttcctgggcaggtggccataagagcagaggagccagtttttggatctgggtggtgccggatgatacatcaagttcagagtctgccaaatatctcaagcactgatcttaggagcagtttagggagggtcagaatcttgtagcctccagctgcatgactcctaaaccataatttctcatcttgtggctaatgttagtcctacaaaggcattctagtctccaggcaagaaggtctgctttgggaaagggctgttaccatctttgtttaaactataaactaagtttctcccaaagttagttcagcctacgtccaggaatgaacgaggacagcttggaggttagaagcaagatggagtcagttaagttagatctctttcactgtctctcataattttgcaaaggtggtttcagtgtggtctgctgaaaggcaggaggctggactcagctccatggatgctgctcgatgaaggagaaatggcacatgtaagaagagtcctaaatgccaagacatatcttttaggacaggttcaacataacatataatgcctgcaggaactttctgatgggggttgtcaagccagcccctcctacccacacaagaagaagccttttttttctttttttttttaatgtttagtgatatagaacagaacaatacaacagtttagaacgagaaggttgaagcatttccctacacttcagcaagcacagctgggtgttgcggagacaagggctgtgtgtcaggcagctgggggtcaaaacttggctcctctgcctgctcacaagtcaggtcccctctctaaacctgtgtcctcatctataaatgaggcagcaaatggtctccctctcatagcactggttataaggagaaaatgccagatgaagacacagcatctgggacagctgccactctttggtcccctcctcacttttctccaatctaatccagggcatcgtttaggttaatggcttggaaaacaggaatgaacactctactaggagtcagcacatctgagttactcctgagccttaataagggtgcttgcctaggcacaatatgaaccatcgtggaatttcaatgtctttgtaatatctgcaaaatcagggtaaaaccaccttccctacctatgttcaagggatgcagggtggtggtggggggtgctgattatttcaacatcaagaagaaaacattagcaatagctacataccttaaaacacacacaccctgtgacccggcaatgtcacttccagtgggtgtcttccacctgagcaggatgacgcatgtacatatacaaggccacccactgcagcgttgttttagtagcccaaggttgggaacaacttacatatccattaacagaagactgtaaactaagtttgatagctccataagttggagtactctacaggtattaattgagcagctgtctatgtcctgatatagaatctttatataaaatgaaacgggtcacatgtggtgcctcatgcctgtaatcccagcactttggaagaccgaggtgggtggatcacctgaggtcaggagttcgtgaccagcctggccaacatggtgaaaccttttctctactaaaaatacaaaaattagcctggcacagtggcaggcacctgtagtcccagctactcaggaggctgaggcaggagaatcacttgaatctgggaggtagaggtctcagtgagccgaaatgttgccactgcactgcagcctatgtgacagagggagactccatctcaaaattaaaataaaataaaataaaataaaataaaatacttactgttttccagtcaggctcgaggtctgaatgtcaggggtgttctgaaccttgggaaggtggtgaaaaggggaagtgctggctgcctctcagtggttatgttcaaggaacatctattcagcacctaggatgtaccaggctcttctgtggagacggtgtctaacaccagggcaagaaggacctgcctggaatcggatctgagctctaatttggatcccatcactaactggccctgtgactgtgggcaagacccatgtcatttcctggcctcaggctcttgtttgtcaacagggggttggactggctggtctgaagatccctcctgtgctaacatcccaggatcaggagttagattgtgaatctagatctttggcaggaaacccaaagtgagcgtctttgctaactctactgggaaacctctaagtcactcacatgggaggcctcttccctggagagagggatattctgagatgaaccacctctgactgcagcctacagtacctgtgtaagtcaatccctgaatcacacaagagtttctctaacagatccacaaacaccaaagctcacggcatctatgcccagcagggccatcagattaaacaatggatctgtgcctctcagaaatcttcccaatgtgatgttttttgaagattaaactaagaaaaacacaatccccctcccaccccgaacaaattccttctcattggaaggaaagagagggtaaggtttgtgagagacaagtttttccctgttttgttcattgcagcttacacagcaaccagggcagagcctggcacatagtaggttttcagtgagtaccagttatataaaaaggagactcggccacccagagggggaaaatgctctgtggaggcagaaggcaagatctggccttgtgcctgggcaagtcacccaatctttcagttccctcatctgcagaaaccaaaggctgggccagatgagaagagacaagttgtggagaaggcagaccagtgttacagactttacccaccatttacaggccatgggtgcctgagtgaatagcatgatgcatcaggccttaacttaactgatctgtagaagggggtgacaccagttcatgaaaatgcgtacccaccaccacacccgattgttgctcaatgaatggaaggtgttactattgacttattgtcacacactgggggacgaaggaggcccacactgtactcactatgcacagacaactcagtgcctggtccagatttaagctccatgtcagggccccctttccagaacttcacacagttgtaggtgccagtgttggctcttgtgatgctagtgatgcacatggaaaagtctgtattgtttctctttgtgatgtctgaaatgcaagctatcttgggaaagtggcctccttttgaactgtagattagttcctgccctgtttcagttcctttgaaccacctgatgggccccaagggcaaagggaggtcacagagtggtcaaacctccagctgtgactgacactgacttctcaggctgaatcacccgcagctcctcctcacctgccgctcctggaggaaaacacaaaacagtcatttaatcatccttatgtgatgcttatgttttctaaagtgtttatcaatgactttcattgactgagtatacaccaggagtgggccttgagctcagcacactgcatgtattatctcatttaaccctcacaacaagcctgtaccatgagactgtattacaagtgagaacactgtggcagagtcaggtccagtttaatggtagagcatgaggttgaggacctgagtagaactcctgaaccctcctttgaaatatcatgctttgccaaatatttgtctctctactttctggccacatggagtgttgctttttctgaatcattgcattgggtggcgccatgtgacttctttagaccactgagttgcgagcagaagtgatgggtataatttgtggtctgtgcatttaatggcaaaagcctctgtggatcaactgctcccttccacaaagacccacaaggctctgatggaagctacttcctcactttggatttctgagtgactataaaatacataactctcaacgcacaatgaacatatggcttaaataagaaataaaacattttttaagccctgaaattttttagccatagcataatcacattacattagattcctaacgatgctctgacaaattactactaaatgtatgtactacaacaatagaaatgtattatcgtacacttccggtggtcacaagtacaaaattggaattgttgagctgtaaccaagaaaaaagaaaagaactcaaatatgcaaaggtggagaataaaactttggtttcctggagtagggttggggaaggttatggggagatgtatgtcgaaagatacaaaattgcagatcgttaggatgaaaaactctacagatgtcatgtacagcatgaagaccctagttaataatattgaattattctcacaatttttactaaaaggtaagattttagatgcacttggcatacacacaaaacaaggtagctatttgagatgatggttatattcatttgcttgactgtaacaatatctatctacctatatatatctcaaagcacttttaaatatatacaatctaagcaggtatcagcagagataatatttttaggcttctgtctcttacctgtccagttctagaggttgttcacattccttttttcacagtttcatcttactatcactccaacctcttgctttcattatcacatgtccttctttaattcttactctcctgcctcctacttataagaactcttgcaatatattggtcccatcctgatactagaccaagactttaaaacaactgtcttaaaatgctcaaagagagccaggtgcggtggctcatgcctgtaatcccagcactttgggaggctgaggtgggtggatcacctgaggtcaggagttcaagaccagcctggccaatgtagtgaaaccccatctctactaaaaacacaaaaaattagctgggcgttgtggcaggcacctgtaatgccagctactagagaggctgaggcaggagaatcacttgaactggggaggcagaggttgcagtgagccaagatcacaccattgcactccagcctgtgcaacaagggcaaaattccatttcaaaaatgctcaaatagctaaaggaaaacgtggacaaaaatctaaaggaaattaggaaaagatgtattaacaaaatgagaacatcaactaagagataaaaaatattaaaatagaaccaaacagaaatagaagagctgaaagtcatgataatgcaacattcgctagaggagtttcataatagattttagcaggaggaagaaagaatcagaaaacttgaaatgaaattattgagtctccaggatagaaagacaaaaaagaataaagaaaaaggaacagaacctgaaggacttatgggataccactaagtggatgaacatacacattatgagaataacagaagaggaagagaaacagagaggaaggagaagatggttatttgaagaaataatatcccaagtcctcccaaagttgattaaatatgtgaatctacaaatataagttgctgaacaaatgccaggtaagataaactcagagacccacactaagatatattataatccaactattgaaagctaaaatgaaacaaagaatcttgaaagcagcaagagagaagccattcctcacatacaagagatcctcagtaagattgttggctgagttcttatcagaagcattggaggccagaggcagtgggatgttatgtttaaagttctgaaagaaaagaaaagccatcaactaagacttctatacctgataagaccatcattcaaaaatatgggataaatcgagatattcctggatacacaaaagctgacagagttcatctcctctagacctgtcctacaagaaatcttaaagggagttctttaggttgaaatgaaaggatgcaacataatacctcaaaattgtctgaagaaataaatattttctgttgtggtttaaaattttagaacttcatatttttctcatgccttgatgtccccacaaacaggctgtgagcaccctgcccacgcaatgaggtgccaatatgataaggctggtccctgataccagttcttgccctcccctactgtaacctagtgatattcaaacacaccagtgaaattccctcatgccatttgcttgtgtactttactgtgactctaataaaggcattttcccaggggtccacccggtctcatctccccacctgctaacttgagccctttctctaggagctccttctaacgggctccctgtgtggcatgtcatgcttcaccttttaggaactatgagtaaaacaaatcatttaattttatatgtctcttcaagtatgacttctgcaactgtgttggaatgatccccaaagatcccaccaatgacacttactccaccatttacaacacaactggtgatgagaatggatcatttaaaatgggtagaaagttcccaggggatgttttttaactgctcatggctcactaatttgctatcctgattggctccaccaatagagacgactttatatcctgctggcaaggtgtgcaccactttgtgtttctgccaggactttccatcctatagtgtggatcctgtcccaatctcaataatatggcccaggataccacttcctatccatgattccagcaagagggggatacttaaactatcattgccagggatctgaagttactgggctatgtggattggctatttctcagtgtacttcggagtgattttgatttgaagaagaactcctgctgatagaatggagatctcctttggtgctgagtgcatatcactctgttccagcctcagcaataaagacaagttgaggagtccagtgggctacagcttgggtgggtggctctctccccactgttcaatgtgttgttgaattacaacaacacagatgcttctcagcttgtggtgaggttatgtcccagtaaacccatcctaacttgaaaatgttgtaagtcaaaaatgcatttaacatacctaacctactgaacatcatagcttagactagcctgccttaaacatgctcaaaacttaaattggcctagagttgggcaaaatcatctacacaaagactacttgataagaatgtattggatatctcctgtaatttattgaataccgtactgaaagtaaaagaatggttgtatgggtactggaagcatggtttttgctgaatgtatcacttgcacaccatcagaaagtaaaaacttagaaatcgagccattgtaagtcagggaccatttgtaatttcctctcttctctcttggtgtcaggcagccctcctttctcagagagtcctccacggcacctcgtagagctctgtgcctccagggctgctgagagcttctctgttgcctcccttgctgctgttgctttcatatcccaactccattggatatctcagatctcatccacggagataggtggctcaatgtttttaaaaagcagagcaaagtgggaaggggcactttgatcccactccccctaagacgcttgaggtttcttagatcattcgagattataaatcaggacgggaagccactcaggactaccaggggcttgtcaggtaaatatccaaagagagaggggaaacctgtatccactcataaatgcgagtcattctaaaatattttgcatcctgggcaacatggcaaaactctgtctctacaaaaaaaaaattatgcaaaaaattagccaggcatggtagagcatgcctatagtcctagctacttagggggctgagatgggaggatcaccagagcctgggaggaggaggctgcagtaagccaggatcataccactgcactccagcctgggtgacagagtgagaccctatgtcaaagtaaataaataaataaaatatttgctgaagagaaaagaagagggagggggatggactgattatattggagtcatcagggccatcccagagagaggctactgcctagaggtgctatcctttttctccttttcctcttactaaccagagacaaaactaaaggcatagcttccagaggcaataatcccaaaataggaaaaaaaaaaaaaaaaaaaaagaaaagaaaaaagaggaaaggagagatttgctgatttaggcacccacaaagccaagatggaaatgaaaatgtacattaacacttatgtactgagcaagtgttaggtttagaaagtgtcacacacgtccctgtgaagagaccaccaaacaggctttgtgtgagcagtaaagtcttttaatcacctgggtgcaggcaggctgagtccaaaaagagtcagtgaagggagataggggtggcactgttttataggatttgggtgggtagtggataattactgtcaaagggggtttttctcttgcaggcaggggcggaggtcactgtgggggagcttctgagccaggagaaggaatttcacaaggttaaatgctcagttaaggtggagcaggaacaaatcacaatggcggaatgtcatcagttaaggcaggaaccggccattttcacttcttttgtgattcttaggccatctggatgtattcatgcaggtcacaggggatatgatggctgagcttgggctcagaggcctgacattcttgtcttcttatatcaataggaaaaataacataaaatagtattgaagttttggggcagcaaacatttttagggggtggtacggagagataatggacgatgtttctcagggctgcttcgagcgggattaggggcagcatgggaacctagagtgggagagattgagctgaaggaagattttgtggtaaggggtgatatggtggggttgttagaagaaacatttgttgtatggaatgattggtgatggcctggatacagttttgaatgaattgaaaaactaaacggaagacacgaggtctgaataagagaaggagaaaaacaggtattaaaggactaagaattgggggacccaggacatctacaattcaagagtgcccaagggggttcagtgtaattacttgcttggttggtgagttttttgggctctattcttgagtttttttatgttgtcatacaccaggccagattgatttaggtaaaaacagttttcatttaaaaatatacagagtcctctttttttagcagtgagttaagtcgaggcctcggcaattttggaggaaagagaaatgcaaagccagcaatcgtttgttaaagaaggattagaaacagctaggagagagtgagcgagattgatagtgtggtggagatagctggggagaggtagagggtggcataagaatggaaacaagagtaagagtgagtataaaagtaaagaataagacttcatcagggtgaaagtattggagtgtaccctgtcagcaaagatcatttatccactttaagagagacttaaggtggtagtttgagataaaaccaggagccgctgaatattaagagcctgagaactgcttgggtgatttgactaataaaaggccggttcattatcagactgtttagaggtgggaaggccaaaccgaggaattatgtctgacggtagggaagaaatgactgcggtggccttctgagaccttgtgggaaaggcctctacccacccagtgaaagtgtctacccagaccaaaaggtattttagtttcctgacttggggcatgtgagtaaagtcaattttccagtcctgggcaggggcaaatccccaagcttgatgtgtagggaagggagggagcctgaacaatccatgaggactagtagaatagccaatggaacgctgagaagtgatttccttgaggatagatttccacaatggaaaggaaataagaggttctaagaggtgggatagcagcttgcaacctacaaggaagacgttatgaaatgacgacagaatagaatcggcctgtgaggctgaaaggagatatttcccttggtctaagaacaatttgccttgtgtgggaagagattgataggtggaagtttcagtggcggagtaggtgggagttactgatgaggagaaaaactggctgtgaaggactgaagttggaacactagctgcttctttagctaccttatcggcataagtgttgccctgagtgatgggatctgatgccttttgatggcctttgcagtgaatgactccagcttcctttggaagtaaagtggtcttgagaagagtttttattaaagaggcattaatgatggaggacccttacgtagtgaggaaacctctttctgcccatataatagcatggtggtgcaggatatggaaggcatatttagagtcagtataaacattgacatgtactccttttgcaagagtgagggcctgagttaaggcaatgagtttggcttgctgagaggtagtggagggggcagagcaggagcctcaatgatagatgtggaagatactatagcaaagcctgcctttgctggtgagtggcgattaggcctggtggaactgacatcaataaaccaagtgtgatcagggtgaagaacaggaaagaagaaaatatagagaaatggagtaaatgtcaggtggatcagagagatacagtcatgggggtcaggtgtggtatctggaataatgtgggagccagtctaaaacagtgaggtcaagtagtttggataggaaggctacagggcgtggtcctggctcttgtgtaagaatttcaaccgcacagccctgtacttcggctgtgtgtaatgaaaagggttgggatgagttaaggagagctagtgtgagagcagcttctagggctgtttttaaggaacggaaagatgagtggtgaaaggatttaggatctatggggtcagctaggtttgtttttgtgagtttgtataatggtttagtcaggatggtaaaactaggtatccaaaggtgaaactatccaaccatgcccaggaaggaaaggagttgttgttttgtagaaggggttggggtttgaaagtttagctggacatgctcagcagggagagcatgtgtgttttcatgaagaattatgctgagataggtaatggatgaggaagaaatttggacttgactgaagtaatgggggctgtccatgaagccttgcagtagtatagcccaggtaatttgctgagcctgatgagtgtcagggtcaatccaagtgaaagtgaagagaggctgggctgaaaggtacaaaggaatagtaaagaaagcatgttggagatccagaacagaataatgggttgcggagggatgtattgaggataggagagtatctgagtttggcaccacggggtggataggcaagacaatttggttgataaggtgcagatcctgaactaacctgtaagacttgtccagtttttggacagttaaatgagggaatagtaaggggagtttataggctttaaaaggccatgctgtaacaggaaagtgataccagggtttaatccttttaaagcatgctgtgggatgggatactggcattgatcaggtaagggtgattaggttttaatgggatggtaaggggtgcatgatcggtcaccaaagagggagtagaggtgtcccaaaatggtggattaagatggggagatacaaggggaggatgtgaaggaggctttgaactggggaaaagggcggcaatgaggtgtggctgtagcctaggaatagtcagggaaggagataatttagttaaaatgtctcaacctaataagggagctgggcaggtagggataacttaaaagaagtgcataaaaactgttcttcaagttggcatcagagttggggagttttaaagaggtttagaagcctggccgtcaatacccacaacagttatggaggcaagggaaacaggcccttgaaaataaggtactgtggagtgggtagcctccgtattgattaagaaggggacggacttaccctccactgtaagagttacccaaagcatctgtgatggtccaggaggcttccgaggtgattgggcaatgtcagtcttcagtcactaagccaagaagatctgggaaggagtcagtcagagagccttgggccagagttccaggggctctgggagtggctgcctggtgagttggacagtccgatttccagtgaagtcccacacagatggggcacagcttaggaggaatcctgggctgcaggcattccttggcccagtggccagatttctggcacttaaagcaagatcctgggggaggaggtcctgaaggaatgcctgaccactgtggatttaggtgttttgaagttcttgtgtattggagatgtggctggggtttctctcacagtggaggcaagtaattgcaactcttttctattattgtacaccttgaaggcgaggttaattaattccttttgtggggtttgagggccggattctaatttttgaagttttttttaatgtcaggagctgactgggtgataaaatgcatattgagaataagacggccttctgacctttcagggtctagcgttgtaaagcatctcacggttgctgccaaaccagccatgaactgggcggggttttcatgtttactttgggtagtttctttaagctttgttctttaacagttctttaacagctttgtaagctgcctttttacacccttcaactaggcaggaaattatataatcttgcctagctatacctggggaatctgcctgatagttccattggggatcctctcggggaactgctctaatgccttcctggaggtctggctcttgaagccggcagttatcagcgtgagattgggctggagaaaaaactctttcccattcatctggggatagggtagaagttaggatgacatttcagtcactccaggttaaattgtaggacagagttagatattggaattcctgtatatatttagtggggtctgatgagaaagagcctaaacactggctgatctgagagaggtctgatagagaaaaaggcacatgtaccctgactatgccttcagttccagccaccgctctaagaggaaattgttgggcaggtgggggagggctagtctcagaatgaaactgtaagctgaaccaggtgtgcacaggggaggtgatagaaggattatagggtggaggagcagaggccaaggaagaatcggagcctgatttagcttggcggggagcgacctgaagaggagcagtctggggaggaggggagaggtcacatgggtcagtaggaaaggaagattgaaaagactcagcgatgcttggggttgggactgagggaacaggtgggggggaaagaaggaggatttggggtgagtcacattgggaacagagactagggagggaccgatgtgtaaaagaatgcctggatgtcaggcacctcagaccatttgcccattttatgacaagaattatctagatcttgtaggatggagaaattgaaagtgccgttttctggctatttggaaccatcgtcgagtttgttttggagtcaaacagcattgcagaagaaaataaggtgtttaggttttaggtcaggtgtgagctgaagaggttttaagtctttgagaacacaggctaagggagaagagggaggaatggagggtggatggttgcccatagtgaaggaggcaagcccagagaaaagagagggtagagacatggagagaaggggtggggggtatttgtgccccagcaaagtggtacttgccactaaggtgaaggatcaaggcaggcgtccctgcggtgatcagacacctctgaaacgtgggtgaataatcaggcaggcatcccgcagtgattaaacaccaagggaagactgtcttcccgagcctgtgactggtgccggagttttgggttcatggataaaacgcatctcctctgtctctaccagaaaaggaaaggaactgaaattaagggaagagagagattgaagggtggcgccaagattgaaaggagaaagaggttaagggatagtgagagaggttggagaagagagtaaaaagaggccactcacccgatttaaaattggtgagatgttccttgggctgcttggtctgaggacccgaggtcataggtggatctttctcacagagcaaagagcaggaggacaggggattgatctcccaagggaggtcccccgatcagagtcatggcaccaaatgtcacgtgcatccatgtgaagagaccactaaacagtctttgtgtgagcaataaagctttttaatcacctgggtgcaggcaggctgagtctgaaaagagagtcagcaaagggagataggggtgaggccatttcataggatttgggtgggtagtggaaaattacagtcaaagggtgtttttctcttgtgggcaggggtgggggtcacaaggtgctcagtgcgggagcttctgaggcaggagaaggaatttcacaaggttaatcacccagttaaggtggggcaggaataaatcacaatggtggagtgtcatcaattaaggcaggcaccggccattttcacttcttttgtgattcttcacttgcttcaggccatctggatgtattcatgcaggtcacaggggatatgatggctgagcttgggctggaggcctgacagaaagcataatgctacccttagattacataatgatttaaaaacaatacacagcaggaaaaagtaaagggtaattaaataaattctgggtacatccgtattttaatataaattgcacaaaaaccttttaatctgaggaatgcaatgcccctttcaattatcaggcccagagaggcactggaatgagaaagcagtcatgtcccacttccctccttcagctaagtaaccatctcttgaggctgcttgccatgtggactctagactgactgatgccccaggtagatacaatttaatgtaacaatgccatatgtggacactataagtcatattctatagttaaataacgtataaaggttactaatcaatgttatttttgtaaagcaatgagaattcctgacaaaaacttttgtaatcatcccctcccctggtttgtcctttttccttaaaagctcgagtctgttctttattctccaaagtgacttggaggtgtttcctgggttacagtcttcaaatttggcccaaatagaccttctacttatattaattttatctaagcttcttctcttaggtagacatgtccgctgtagtcagcaggattcagagggacctcccaacactgaacatgctgccttccctcttgggctcagtgcttggtaccagcattaatgcactatgttcctcagactccagaggtttcacagggtgtaaaagggtgagtcctcctgaattcagatctccctttcttttttggtgaggttttgcctttatttgggctgttctctccaactgcctctctttagaatggaggttttgatctctgtctatgggcaggagattctggtttcaggaataaaacaaaagataactgtctcctctgctgctatttcacagcaggtgttccaggtcgtagcattggcagtctaccataagtagtttcatttcttttggcctaaaattacatagcatgctgttaaaattgtagctgttccctattgcatgaaattcagacttgtattttcatttgtgaccaattcctgtttgttcaaaaccaaaggaaacatgaggatgagttcaattctctcgaagagaattgcatgaacagctgttacatgcaggagagggactcatgactcactggtgacactttgtggagtgatgctcacaaagcaacacactttgacctgatacactgtcctagccttggacacttttgaaaaggaaattctaaaattacgggaaactgctggacgaaactgagctttcctttaaggggcaaccatccttaggaagaccagctgcatttatgtataatacttactgtattagtctgttctcacactgctataaagaaatacctgacactgggtaatttataaagaaaagaggtttagtcagctaggtgcagtggctcatgtctgtaatcccagcactttgggaggcagaggcagggggatcacctgatatcaggagttcaagaccagcctgaccaacacggtgaaatcccgtctctactaaaaatataaaaattagcaaagcatggtgacacgtgccagtaatcccagctactcaggaggccaaggcaggagaaatgcttacacccgggagggagaggttacagggagctgagatcgcgccactgcattccagcctgggtgacagagcaagactccatctcaaaaaaaaaaaagaaaaaaaaaagaaaagaaaagaaaaagaaaaagaaaaaaaaagagaggctggataggtggagcacagggatttttaggacagtgaaactattctgtacaatacatcaatggtggatgcatgtcattatacatccatagagtgtacaacaccaagtgggtatatgggaactccctgtactttctgttcaatttttctgtgaacctaaaacttctctaaaaagtagtttagtaggttttttttagtgtgtgtgtgtgtgtgtgtgtgtaagtccctctagtaaccaggcatgacggcatccacctgtagtcccagctaccagggaggctgaggtgggaggatcacttgagctcagaagttcaaggacagcgtggacaatacagccagaccctgtctcttgaaaaaacaaagtcttggcacttccagagcccggtgctgccggccgcgggagatgagtgcccagtagggagacttctgtgaagcgtcccggtcctgcgacgtcgcccacccgggaggaggcggcttctcggttcctcaaggcccccgggagtccgaacctcggcaggaggctggcagcggcgtggggacccagagggcaggggcggtctgcggggcggccctgggactccctccctccctctcctgctgcggccgccctgggatatgggggccgtggatgtgggtcgccgctggaggtgtggccctgggtggtccatccggccgcagaggcccgtcccccgttcacccaggccggtaccctatggagcacctattacgtgcagtgctattctgggttcctgggatgccaccgagtgagacggacacacagactctcagcccagaggggaaccgtccctattaatcaggtatgatcctccctctgcccgtcgcctaataaccccattgtttccagacaacagatcaacaagtgcttcacgtgcaggcggcctggcatgcctggcatcttccagcacactccccttggctctgctacagcctttttggccttttacttcttgaacgtgtggttccttgggtaacgatgccctctttggtctggttaattcccctccttaggatttcttgtattagggcaatccttgctagtttctgtgtacaatttgccttttcatgggtttttcggactaccacatactcgttcctagcacttagcacaggcgtaaccttacagttatttgagtgcaagttacacaagaacaagaatttttccgcctaatttctagtaccaaccacattgcttggcacagagtatggttcaataaatatttgttggctgagaggcaaatgtatttgtaattatcatgtgagatacctgctgtaaaaaaaagggaatacctgcctggcagatgtgacttaatttgcatcctccaggatatggttttttgttttttttttttttgttttttttttacagagtcttgctctgttgtccaggctggagtgcagtggcgcgatctcccatctgcacttactgcaatgtctgccttccaggttcaagcgattctcctgcctcgacctcccaagtagctgggactacaggcgcatgccaccatgcccagctaattttttgtatttttagtagagacggggtttcaccgtgttagccaggatgctctcaatctcctgacctcatgatctgcctgcctcaacctccctaagcgctgggattacaggcgtgagccaccgcacccggccaggatatggcttttaagttgagatcttcagggtgagcagagcagaagtctcccttgaagccaggagctcaagcatagcctgggcaaaatagtgagactctgtttctccaaaaacatatgaagtttagcagggcatactggcatgcacctgtagtcccagctacttgggaggctgaggtgggaggatccttgagcctaggagtttgaggctgtagtgagcaatgattatgccactgcattccagcctggaagacagagtgagacctgaccatatacgtgtacatatatgattattacacaattggagattgaaatataatctataatcagtttttcatttactgtatttgaatatttgcctatgttgcaaaatattccacaatatggtttttaatgtttagtttatttttttccaatttataccaaactgttggatataaagtttgcattttttgatattataaataactctgcagtgaatatgagctgaaatctcagataaattcaagttgagatttttaaaattaaaaattggttttaaaatttggatacttaaacagtatatatgtacatggtaagaaaaagagttacctaagattctatggttaaaaaagcttccttgtctaggtgcggtggttcatgcctgtaatcgtaacactttcggaggctgaggcaggcagatcacctgaggtcaggagtttgagaccagcctggccaacatggtgaaaccctgtctctaccaaaaatataaaaattagctgggcatggtggcacacacctgtaatcccagctactcaggaggctgaggcaggagaattgcttgaacctgggaggtggaggttgcagtgagccaaaatcacaccactgcactccagcctgggcaacagtgagattccgtctcaaaaaaaaacttccatctctacttagaccctcagccccactctccagagaagaccactggtacattttctaaatgagagaaaatcatatgcactgttctgaacctgccatctgatacttaatagaacagatcgaaacattcttaggtaggtatttctgtgaaggaaaagttgcaacagtttacactcccgccagcagataatgggagtctggttccttgtactttctctagcttgaggaattatcaattatcactttttaagttctcaatctgatggatagaaaattacattttattgttttaatttgccatctttatttactagagagtaagaagctttttatatgcttattggttattgataggtgaattgatcacttgctatggtttggatgtttgtccactacaaacctcatgttaaaatttgatccctgatatggtttagctgtgtccccacccaaatctcatcttgaattgtaatagcctccacatgtcaagggtggggccaggtggagataattgaatcatggggccagtttccccatactgttcttgtggtagtgaataagtctcacgagatccaatgggtttataaataagagttcccctgcacaagctctcttgcctgccgtcatgtaagacatgattttgtgcctcctttgccttctgccatgattgtgaggcctccccactcatgtggaactgtgagtccattaaacctcctttcctttataaattacctagtcttggatatgtctttattagcagtgtgagaacagactaatacaatccccaatattggaggtagggcctaatggcaggtatttggatcatgagggcagatccctcatgaatagattaataccctccctgcagagggtgggggggtgggcacagtgagtgatttcttatgattaagagctggtggttcaaaagagcatggcatctcccctgttctctctgttgcttcctctcttgccatgtgatctctgcacatgccagctccccttccccttctgccttgagtggaagcaacctgaggccctcaccagatgcagatgcctagccttgatctttccagccatcagtcatgagcaaaatcaacctcttttctttttaaattaaaaaaagtaaaaacaaagtctctctagtaatataaaatgataaaacataaaattgaatcagatgtaaaatgtgttgtggacccctgacgtttttgcaacacaatcaaaacccatttcctctctcttgccagcagaggaaataggtttagttaaacaaggatgtgtttttggaggggtcatttggaaagggaagagaaatgatgggaggagaaaacgataatcaaacctctgtgggagagagggtcacacagattttaacacctttaacatgggaagtcaccattcccatctactccccatgtaggcagagaaatggggagaggcagaggagaaatgcccagaacaggagggaatggccaggagttgggcaagtcagttggcccctcctgggctcagttttatcccctgtaaaccagaagtagcaatacttaccttacactcttttgtggagattaaataaaataaagtgtttgctatgcaatgatgctgaataaatagtactaattgtcatacctgatgcttggcaaacaacaggaaattgctaagtgttgaatgaatcttactgtatgttgtcagtcactgacctctggcttttccaggtgctgtggacctactgacactttttcttatctggtattgtagaatttctcttgcctctccaaggccaactcctccctctgggattcctttggtccctcccacttgttaatccacagagctggcatccttatcatcagttatggaaagcctatggcttggtttcactggaacagtctcgggttatacctgttgtcctcatgttttgcttgtttgggtatttgtcctttttgttgttgttttaacaaagtattattgtcaatagttgcattaactgaagctggggtggatttagtaaacttccactttgtacttgcagcttctgccgtgctctcaccttataggctgtgagatacatgtgtagtgagcgaagtgcttttttttagcacttggtcacagtgtaactaaccccttctttttgagaacagcatgaggggcactcaatgataaagcaaagtgcagtctcatgccagcagcctagaaaaagcttgattagatggaaatcagaagacacagattgccaatcacaagaaccatcagcatctacttcaaaagttaatagctacattaagaagatggcgctaaaagataatgattaaaatgagggctacaaaaggtgagcctacatattactctatgaagcatgacttcatttagatcaaaagactgttcttctaagttaattatactcattactttctccaagtttttttatgcacacatgaaaagtgaagcaatggttgttaatgtgttggctccattaagagaagtcagcagttaaatgatgccatcagaggattcaaatagaaaatcatgatttaatgtttttcatttaattcatgaaatcaaaagtcttttggaaattcactcttgtagtttaagcatttgacattattgtgattaatattgaaatcagttgacaagtgcaacacagaggtaaaattacttatattggtaaaaataatgttcttactaaattaagaaacctgtaactagaaatgcacttggacttggttgttgcatgtgcctaatttctaaccatatccaaataagctgcaccattccaccatttgaaatagaaggtacagttgtcataatttataaagattttatacagttaaattaactgaactaaaaaagtttatgacaaagctgaacacaaaaggatatttcctaatggcagtacatgttctttgtccccttttccaattacaaaacaacttcacattttatgttataaaatatagtcatttgttgagaacataaagcctaggagaatgggtattttgatacaaactctgaacaaaacaccacccttgctacttcctgcacaatgattatgtttaacgaatagctcatcatcctgtacacaagctatttcattcgtgagaactgaagctgcttaaaaacattgataactttccaattccccagaagaggtcttatatataggcaatgtataggatatttattaaattggtgttgtatacacttaatattacatatccaagaaaagaaatttgagaaagagaaattaaaatgcacttgggagtttttttttcttgcaaccggtgttaaattcagctctttacctacagaatgcaaaacaagacacccaagaagaaccccactgttgttaagttacaaattgctgtacgtaagaaacagtttatttgaaggaaaatgcacttatttttaagttagtatcacaccatgtataacctaaagttagaaaagtcacttatttgaaggcacaattctattccagattatagacaaatcaaaatcttacagacctcacctggcaagaaaaatgaggtcactggtctatcctgtggctccagagtctacgtcacggtcacacccaggcctccaggagcagtatctagttctgtaagacagaaagttctatttctttctttcctctttctttctctgtctttctctttccttcccttctctctttccttctttctttttcccttccttccttttctttctctttctttccctccctccctctttctctttttctttctgtcttttcttctttctttttctttctttctttctctcttcctttctttctttccttctttctccttccttccttccttccctcctttcttctttttccctccctccctcccttcctttcttcctgctatattcaccatgtgaaaagattctgcagcctcctccgggctttcttcattctacccgaaaaggcaaatgacttcactttctaaagtagcatcagcaaccgctcttttgtggcaggaggaacaggaattgaagacccagcagaaagcagaagtcaactgctatagacagccttgacatagcttaagctaaaggctttgaacgagaataaaacaaaatacataagccctccaacatgtcagaagaagatagatttttagaaaaaataaggttgccctttcctttcatctgcttaaggaaaaaaaaaaagagagcgggtgggggccgtgactggcttcatcaagccagtaaaagacaatgaaggtccataaaatactctatggtattactttacttcaaaatagtagttttcctcaggccactgaaaaaatggtagcaacctataaatgtatacatttgaaaaaaaaagtttaggtccaaggtaatgactaatctctgagtctgtgcctataaagagaaacaatgattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctaaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccgttgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggaggactacaaaccactgctcaaggaaataaaagaggatacaaacaaatggaagaacattccatgctcatgggtaggaagaatcaatatcgtgaaaatggccatattgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacacaacagagccctcagaaataacgccacatacctacaactatccgatctttgacaaacctgagaaaaacaagcaatggggaaaggattccctatttaataaatggtgctgtgaaaactggctagccatatgtagaaagctgaaactggatcccttccttgcaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagccaaaattgacaaatgggatctaattaaactaaagagcttcagcacagcaaaagaaactaccatcagagtgaacaggcaacctacaacatgggggaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacagtgagatcacatggacacaggaaggggaatatcacactctggggactgtggtggggtcgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaataaaaaataaaaataaattaaaaaaaaagagaaacaatgattatgacaaaagaagatgttagagaaggaaaatggaaaaacttgagtagaaatgtacacacaagtgctccccattctggtctcatgcttctaaacagccttttccctgaaagccttccaaactagttctgcttgggcaagatgtatgtctaaattcttttgcttttatcagttgtcaagaacataatgttgagttcaaaggataaccaaaccttgaatctgattagcttttattccattctcacttgcaaaaatcatgaactaagctttatttagcccttcactgggatatctgtaacgacatggatcagactccttgaagtgactgcgatatggccagacttcatagaaaactgtgttggctgatggagactctcaatatttataggaaagtcatgtgtaatgagatgggacttctacagattaattgtcccaccactggaggaagtgcagctgccctgggtgcagccctgcctctttttgctctgctgccttaggccattggagctaccacttctagtacaagcccttctgctctcccaagcccttggcataagtgtcaagatctctgaagtgttgtctgaaagttctcttgcttggtttcaggtgcttccccctcactcctgaccctgaggatgggaggaaacttgctatagcccttaacgactccttccaaagatctttcctttccctgcttctctgtacttttgttttttttttgtagcaactttattcataataatcccacactggaaataacacaaatattcatcagcaaatacataaaccaattgtggtatattacaatgaaatcctattcagcaataaaaataaaaagctacagacatatgcaacagcaagtatctctaaacatgttaaggtaaagaaactaaacacaagagtatatactatctgatttaattcatatgaaattctaaatcagggaagaaaactaaccttccagtaacagaaggtggatcagtggtgacctagggctggggagaatgactgcaaagggagaggaaatttattctggtaagaaaatgttctttactttgattgggggtggtggttacatggttgtacacggtcatcaaagatcattgaactctacagtaaaaatggctacacttaattatagtaaattatactttcattaagttgatcagaaagaaaaaacgtcccaatgaggcgatagtcaaaagtcaccacaccagtgtctgtcttaatatttgaataggcactaaatttctaggtttctatttgtttcatagcacatgtcagggggccaagtttccatctaaataaatggcttaatgaattaaattatatagaggaagatacttttatatatatatatacttcttttattttcagagatagggtcttcctctgtcacccagcgtggagtgcagtagtgcaattatagctcattgcagccagcctaaaagaggaagatataacaaaattattcaagaaatgaatcaaagcctatggtctaaatgttttccaactgagtgattaacttttgatatgctattttgtgtttatgtttgaatcctgagttgtcaagtgtttagaaaaatctgtcaagtacacaagtctacctttgtggtagttggatcaaaatattaaatctcttatcaaatgtttaagaaaatgtgattaacaaattatgtaagtggtatcaaatgttcaggataattggaatttacaaattgttaaagaaatgggaatgtaatttctcatttttatcgaatttactgttcttatgatatcttcaagttgagcttagagatttaaaaatgctgtattttaaaagtaaaactaacattgttaacattatttactgtaagttatctttgtaagagtggtaaaatatatacatgatgtgtcgttacataatttcatttaaaaaacgcatcactttatgtgtttttatattgctataaaccataaggccagtctacaaggtttgtagataaaatagaaacataccttccttgaaaagcagaataaatttcttaaaaggcaggacggaagtgtttgaactatgtgtcaacaagctttactgtcaaagcaggcttttggtatggaaagaaaaatacttataaatacttgttttaatatttgctttattaaaatacatttaaaatacagcttctctctactcttcaacttctcatgtaggttggaggtgggtggttgctaatgtaggcatgacttgtttttgcagcctcttcctatgttctgcttaggtggtctagggtcctggaggtatttgccatgggctcaactgtccttgaccttctcaacttgtaaagacaatagaaatatttgcttctaacaaaatttcattattcacatagcaacttatcttcttgaggaaatattcaagaaaccagactgctgtccttagaaatatgtgccaacttcatgcatgcgtctctgaaggtcctcattattcttccctcttgagatgggggagacccttattattcattcacaatcctgtgggaagtgcagggagcctttcctttagaaaatatgctatttatctaaaggtggaggtttgaagaacagaggttttaagcatcacactcagaaatggaaatgttatgagagacaatagggtttccagttacagccctaaaactcaacatgttcaaaattaaatgcctgatctccccatccaaaggtgctccatgtgctgctttttctaacacacttgacggcaatgtgttattccagtctcttaggcccaaaatcttggggacatcactgacttctctctctctctcactctacagattagcaaatcctatgagttctatatggaaaatatatccagggaaattcagcttctgcttaggatgataaaattcagaaagagtgtcatctccactcttacaacaaaaatttatagttgtataatctacaaaataaaatcttttcttgaactgatcagagagctgaagttgcagggcaattggctaatctgaaatctaaagaaaaacagatgcctccaagaagacatgagccatgtgcaaatgcctccctggggcagaggctggacgccaaataaactggtaagaaaaattcaaagttttttttgccaaattgctaaagtgagtatgtgtgggctaacatgagaatatagaaccccagagatccatggacatgaaagaaatttacatgtacatgcaggctcttctccacagactttactggattctcagaaaggttgggtcgggatgagagttcagagaaaggttccttcatggtgcagacctaggggacgtgggcaacagctactgtaggaaaaagcccaaagccccacccagatccttcacatctgtctcccatatggaacaaagcattaagcagctggaaagaacagcaaatctgcttttcctcaggtaaaggaacagaaagaaaacccttttgtaccactggggaaaggatagaaaaatatcctgggcctaaaccattagagatctactgagatgcccaagggaaggaccactgagaagtctccacttctggaaccctggaccatagtgactaacactgtgactgaaccataacaacagagctccctgtgcatacaccccccgccccaaccgggttaataggtcctgagtgataagtaacagcagtctactactgataaaggggagatacaaagaaggacccactctgaggcgcaggtgtgcaaagggaagacctaaagcagagggtaaagcacctattgagaaaaatcttctgcaaacaagtccatccagaacacaaggcaacagaggattagaagcctgggtgcactgaaaataaacacagcattatcagtacccaaacttagggtactgttcatctaataactagattgactcaacctcacataaaaactgcctagtaagggtaattggcaggccatatgcagaagattgaaactggacctcttccttacattatatacaaaaatcaacttaagatgtattaaagacttaaatgtaaaacccaaaactataaactataaaaaccctggaagataacctagaatataccattctggatatagggcctggtaaatatttcatcatgaagactccaaaagcaactgcaacaaaaatagaaattgactaatgggacctaattaaattagagagcttctgcacagcaaaacagactatcaagagagtaaacagacaacttacagaatgggagaaaatattagcacactatgcattcgacaaaggcctaatatcagggctctacaaaaacttaaacaaattaacaagcaaaaaacaaacaactccatgaaaatgtgggcaaaggacatggacagacaattttcagaataagacatacacatagccaacaagcatatgaaaaaatactcatcatcactaaacgttagagaaatgcaaatcaaaaccacaatgagataccatttcacatcaatcagaatggctactatcaaaaagttttaaaaaaaaaaccagatgctaggaacgttgtggagaaaagggaatacttacatgctgctaatgggaattagttcagccattacggaaagtagtctggcaatttctcaaagaacttaaaattgaattagcatttgacccagcagtctcattattgggtatatccaaagaaatacttaactatgaagcaatagtaaccaagaaaatttagtactgataaagatagacatacatatcaatggaatataattgagagtcaagaaataaacccacacatctgtggtcaactgattttcaacaagcatgctaagaccattcaatgatgaaagaatagtctcttcaacgtgattctgggacaactggataaccacatacatatacaatataaacaatttaactcaaggtggatcaaagatttaaatgcaagagctaaaactgtaaatctcttaaaagaaaatgtagggataaatcttcatgaccttggataataaagtaaaaaaatacttcatggaatgggagaaaatattccaaattatatatctaagaaggaactggtatctagaaaatagatatagacagatagatgataaatgatagatagatagatagatagatagatagatagatagataatcacttacaactcaataataaaaatacaaataactcaattttcaaaaagagaaagtatctaagtagatatttctccaaagataagcacatgaaaagatcctccatgtcattaataaccaggaaaatacaaatcaaaaccacaatgagatacccttatatggtagtggaaacttaaaatggtattcttgctttggaaaataatctggcagttcctcaagtgtttaaacatagaattaccatatgatccaacaattacacccctagagaatacccaagagaaattttaaaaaatgtgtccacacaaaagcctttgggttatttagcagtgtactgtttattttcaaatttcttgttatctagacacacacacacacacacatacacacacgtgcacgaaaatgaatatgtgagatacagctaaagaaatgctgagagggaaatttctatctctaaattcttacattaggaaaaaagatctcaaatcaataatcgaagctcacacctttaaaagctagaaaaaggctgggcacggtggctcagacctgtaatcttagcacttttggaggtgggcagatcatttgcagtcaggagtttgagaccagcctggccaacatagtgaaaccccatctctactaaaaatacaaaaattagctggacgtggtggtgggtgcctgtagtcccagctactcgtgaggctgagacaggagaatgacttgaattcaggaagcagaggttgcagtgaactgagatcatgccattgcactccagcctaggtgacagagcgagactccatctcaaaaaaaaagaaaaatcctaggaaaaaatagcaaaataaaccccaaatgagcagaatgaagacgcatggctgattctatgtttgaaaatctgtcagtatagttcattgcaataacagtctaaagaagaaaaatcagatgactgtatcaagttattagaaaaagcatttgacaaaattctacacactgtcatgattaaaaactcagaaagctagatattatagaggaactttctcaacttgataaataacatctaccaaggagacatcatggctgactagagatacccaacactcacctctttcacaaagaaagatcaaaacagagagtggacaaccacatattgaatagagtgtgtaagagaaaacactggaattcatcagggaagtgacaggaaccctctgaggcactgaaagaaagggaagtgagcagttgccctggctgggatcagctcagtgccaggaagaactccccattgtgggaaaatggtaagcaagagattcacagtgatgcacattctcaccatggacacctataagcctagccacaggagaacctcttggcccttacaggccataagcctagtatgggagctgcctagagttcatgtgactgcatcgtttcagggagaaaattcacactggatcccactcacctctcaagacccaagctccttaagggaattctacatttggaagttaagggaaaatatctaccatcatgaaaacacacaaaagtgtaaacatcactggtggagcagataaacaaatgaaaaagagaaagaaatataatgttgtcactacagaaaaccaccaaatcacaaaagtaaccaataagagaggaagaaaaaacaaaggatgtacaagtcaatcagaaacaaataagaaaatgacaggagtacttcctcacctatcaattacgatcttgaatgtaaacagtttacatatgcagttaaaagatatagactggctgaatggataaaaaagacaagacacaattatatgctgcttacaagaaactcacttcacctgtaaagacacatagattgaaactgaagggatgaaaaaagatattttacccaaatagaaaccaaaagcaggtaggattagctatatttgtattagataaaatagactttaagtcaaaaaacataaaaagagataaaatggtcatagtactggtataaaaataaacacacagaccaatgtaacagaatagagaccacagaaataaagccaaatacttacagccaactgatctttgacatagcaaacaaaaacatgtaagtggagcaaggacaccttattcaacaaattgtgctgggacaattggaaagccacatgtaggggaatgagactggatcctcaaatgaaaaaggagacattacaactgataccacagaaataccaaggatcatcatagactatgatgaacaattatatgctaacaaattgtaaaccaagaggaaatagataaatgcctggacgtatacaacacaccaagattgaactagaaaggaacagaaaatctgaacataccaataacaagtaacaagattgaaccagtaataaaaaactctcccaacaaagaaaagcccaggaccaaacagctttactgctaaatcctaccaaacttataacaaactaacactaattcttcttaaactgctcaaaaaaattgaaggggaatttttactaactcattctatgaggccagcattaccctgataccaaaaccagacaaggaaacaataaaaaagaaaactgcaggcaatacccctgactaacatagatgcaaaaatcctcagcaaaatactagtaagctaaatccaacaacacatcaaaaagataatacatcatgatcaaataacatttattctagggatgcaaggatggttcaacacacacaaatcaataaatgtgatacatcacagcagcagaaggaaagacaaaaaccatatgatcatctcaatagatgcagaaaaaaggatttgataaaattcaacatcccttctaaataaaacttactcttaacaaattaggcactgaaagaacatacctcaacataataaaggccatatataacaaacccacagctactgaatggggaaaagcaaaagcctttcttcctttatgcactggaacaaggcaaagatgcccactttgaccactcctattcattatagtagtggaagtctgaatcagaatgatcaagcagaagaaagaaataaaagatccaaattggaaaagaaaaagtcaaattgtccctctttgcagatgatatgatcttatatatagaaaaagactaaagactccaccaaaaacctcttagaactaataaacaaattcagtaaagttgcaggatgcaaaatcaacactaaaattagtagtatttttatacaccaacaataaatagctgaagaacacatttaaaaagcaatcccattttcaatagctataaaaataaaataaaataaaataaaatatctaggaatacagttaaccaaggaggtgaaaaacctccacaataaaaactacaaaatactgatgaaagaaatttaagagaatacaaaataatggaaaaacatcctgtgctcatggattataagaactgatattgttaaaatgatcatactacccaaaacaatccacagatgcaatgcaatccctatcaaaataccaattatattcttcacagacagaaaaaaaaaatcctaaaatttgtatggaaccacgaaagatcctaaatagtcaaagcaatgctgagcaaaaaaaacaaagctagaggtatcacactaccttacttcaaaacatactataaagctgcagttaccaagacagcatggtattggtatatagacacataaaaaaaatgaaacagaatagaaaacccagaaataaatctgtgtattcacctgacattcaataaaggcccctaaaacatacatcagagaaaggatatcttatcaataaatggtgccagaataattggatatccatatgcagaagaatgaaacgacctctgtctctcaccatacacaacaatcacctgaaaatggattaaagacttaaatgtaagacctgaagctataaaactactggaagaaaatacagaggaactgcttcagggcattgctatagccatagattttatggataagacttcaaaagcacaggcaacaaggcaacaaaacagacaaataggactatattaaactaaaaaactactgcacagcaaagaaaacaatcagcagagtgaggagacaacttgtagaatgggagaaaagtttgcaaactattcacccaacaacggtctgatattcagaatatacaaggaactcacacaacttaacaaccaaaaacaaataacccaatttaaaagtgggcaaattatctaattagacatttctcaaaagaaggcatacaaataaatggccgacaaatatatgaaaagacgttcaacatcactaaccatgaggaaatgcaaatcaaaaccacaatgagatatctcaccccagttaagattggctattatcaaagagacaaaaaataacaaatgctggcaaggatgtgaagaaagggaaattcttatacactgttggtgggaatgtaaattagtagagccattattgaaagtagtataaagacttctctgaaaactaaaaatagaactaccttacaatccagcaatcctactactgggtatttatccaaaggaaaggaaatcagtttctcaaagggatgctcatgtttattgcagcactattcactattgcaaaggtatggaatcagcctaaatgtccatcaacagatgaatgaataaaaaaatgtggtattatgtgcacaatagaatactactcagccatttaaaaaaaaaaaaaaagaatgaaatcctgtcatttgcagcaacatggatgagcctggaggacattgttaagtaaaataagtcaggcgcagaaagacaaataccacgtgttcttacatgtgggaactaaaaaaaaatggagcccatagaagtagagacttacggttatcagaggctgggaagggtaggagggtagggaagatacggagaagttggtgaatggttacaaatttcagctagatatgaaaaatgagttctgatgttccacagcactgtagggtgcatatggtaaactataagttactgcatttttcaaaaagctagaagaaagaattttgaatgttcccaaaacaaagaaatgataaatgtttgaagtgctggatatcctaattaccctgatttgatcattatacttcatatgcctgtttcaaaatatcactctgtgcaccttaaatacgtataattattatgtgtcaactaaaatttttttttaaaaaggacatctacaaaaacaaaatgctacagctaacatgcttaatgatgaaagattgaagcctttctccctagataggggtagaaacaagaatgttttctctcatcactctttttttaaaagcaggaataaacaaaatattaatgattgtttaaaggataacacttaaatatttacaaagtaaaaatttaaaatatcttgaccagggttttctatgtattatgttaccatcatgactctgattttacctttcctagagcagtttctcagaaagaaagtaaaagaactaataacagtctctggggcttgcattgcctgctcaggcctgttgtcccctggcagatcaaagcactgaaatgaagaagcagtgtcctcacccctctctctcctcctcgcccctctctcttgccccttttgtttttactttgagtatttctgaataataaatgcaaaattagggttgaatataaaccaaaagagccagatgaccaccccaattcaagattgcatttcattccaggagacctggcacagaaaggattccccttcatctacagggttactgcaacagaaatcaaagatcatacatgaatatcatttgtaggctctgagcaaagacaaacctagtataaattcatctgcaagtgaggagatttgaaccaggtggtctgttatgtcccatctagcctggcaagccagcgtgaaagctcagatcttccaccgtgaaaggacttgccctccccgctaaggtggacgcagaaaggaaagaccatcatactgtggcaccaaccttctaatataaaaaagaactatgttggggttaaagtacatcaataaagtacaaatttttaccatacttacaggacaaattaattcttaatagtttgaaatatatgtataccataaaactctgtcaacctacatacaccaaagactttcctgtgggtatagaaaatctgagtaagccaagcaaattacttgaaatcctgagaggccatacataatcttctgcatccattatgcctctctattatacgttattttctaggtcacttgaacaagagcatttcttacctcagagggtctaaaacaccttttttttttttttttgagacggagtctcactgtgttgcccaggctggagtgcagtggcaccatctcggctcactgtaagctccgcctcccgagttcacaccattctcctgcctcagcctcccgagtagctgggactacaggtgcccgccaccatgcccagctaattttttttgtatttttagtagagatggggttttactgtgttagccaggatggtatcgatctcctgacctcgtgatccgcctgcctcggcctcccaaagtgctgggattacaggtgtaagtcaccatgcccagccctctaaaacaccttttttaaaaaacttatgattcaaggatttgaaatcctaacgttacaggcaaaatctcatttttataaaatataaaatgctgtgtttctttcacacctaatagcttgtcaagagaagtcactactaaattgcattcctgcagcctttccaggtagtgggatactgcttgtttgatctccactgaaccccgtacaggagtgataagtttcacgtcttgcaattctgccactccatttattccagggctggagcgatctgcaatttgatatcaggatgattatcctgttatgccttcattatttggggtgttgctgtacctgttcctttttgtttgtttgtttggttttttttttttgagaagaacaagactttccagattccatcctcttggccagctcttctgctgatgtcatgtcagttttagcaactaaaaagtcagaggtgattccttccatggttttgtttgggtcttgcaaaatgttaagaacaacttcctgtaacacttgtgttggtattgcctcatttttaatggccttttcatatagcccagtagcatcataggtgcctttcttggctaacaactttgctttgtagaaccagaatttagcagttcttcagcctcaggaatactagacaatatggcaaatatttccttaaaaaccacacccctttcaatgagctgcagacattctgtcagagtgttgttagttttatggagcagttgaagctgtgctttcttttcttcctcttttttttcaacggtcttccagaatatttattttctctattatttttctttctgttttacgtgtcataggaggccacttatagattttccccttagatttctgtcattcttccagttgtttcctttgatcctctgctattgtcttcttttcggtatttggattcatttgggtcccttttgacactccttttccttcatgattgtgttaccagcttgagttttgggagctctcttgtttagaaaacagaagagcctttttcagcttggagaccaatgcctgtgctctatgttgtaagctgttgtggcatttgtccccattagttccatttgctcttacgccgtgggtgctgggaatgactgaatttaagctgccaactgtcaaactagcctctggcttatagcttttgatttttgcagtgcacacgaccaaggcccaaaacaaggttgaatggactgctgatcttgcttaatgtttaaatgtctgttactatatcctccctgaaacaaactggagtatgtcctggttttggtatgttttacttcctattcactaacttatacatgctctttaataattaaccctattaacctttgtaccctccaccattaattttttatttttgatgcttgagtcctactaagggtctgaacaaagagagagggaactgtcttgggggcttttctcccagtcttggaagatcttcttgagagagttgctatgactttactgatagaagcttgacttgtgtttctccaacaaattgtttatgaactctgtctttcagggcagcactagtcactgaatatctgcccaaggcttgttgaggaaccaaattgctcttggttcaattatgagagttattctttaacttctttatagtacataattgagagtctggcttcctctcagggtctgacaaggtttgaggcaaattctcttcattaatctcttttagaaagctaaccaaagattaattttcaatgcgggcatttcctatggagtctgtacacttaacattccttgatatgttaactgctgctttgtagtcttcaaatcctgtgcattaagtgaccccatgggttttcttgacagcttttccatggtgaatgatccagctttgtgctgctgtaagctactgctggaggcttacagtttggttagaaggaacatattcagccttttgcccagttttagtggcttcaactttggcttctgggaccttgtaatattggcttgtctggcctggagtttaatgctgatgggccttatgctttaacaggcaaaacagcatgattgataacattctcttggatagatttgggcaattatttttggcttttagataaagctcagtgtttggcacttgaagttcctttcgacttctaggtactcctggagctttctctgttgttcggtggcagcagtggtggtgacaggccctggcctcaccatgacttctcagtcacagtgtttcttcctctctcaccacttttattgagtatagtactggaagtcctagccagggcaataaggctagaaaaggaaataaaaggcatacatatcagaaagaaagaaataaaactatctctatttgtagatgacataatagcctttgtaggaaattctacagaatctacagaagagactcttagaactgataagtgagttcagaatggtgacagactacgtgatcaacatgcaaaaagttaactttaattctttttttttagacatagtttcactctgtcgcccaggctggagtgcagtggcatgatcttggctcaccacaacctccgactccagagttcaagtgattctccagcctcagcctcccaagtagctgggactacaggtgtccgccaccatgcccagccaatttttgtatttttagcagagacaggatttcaccatgttggccaggctggtctcaatctcctgacctcaggtgatccacctgcctcggcctcccaacatgcttggattacaggcgtaagtcaccatgcctggccaagttacctttaattctatatactagcaataaacccatgaaaaccaaaatttaaaatataataccatttaatttgctcaaaaatgaaatagctataaatttaacaaaacatatataagacttgtatgctgaaaactgcaaacactgatgaaagaaatcaaagaagattcaaataaagaggaatgtgttagtcagcattctccagacaaacagaaccaataggatacatatatcaatagatggatgagatgggatttactatgggaattgactcacgtgatcatggaggccgagaagtcccgcgatatgctgtctgcaagctggagaaccagagaagctggtggagtggctcgttctgcatttgaaggcctgagaaccaggggagatgttggcgtatctgtcagtcagaggctgaaggcctcagactctacagaggtagagattgggactgggtaatctcatagcactggtgtaagtcttggagtccagtggccagataacctggagttctgatatccaagggcaggagaagattggtgtcccagctcctgaagaaagagtgaattcatctttcctctgcctttttgttctatccaggctcttaactgattgaatggtgcccatcttcattagatgagggcagatcttccttactcagtccactgattcagacactaatctcttccagaaataccctcagagacacacccagaaataatgttttgccagctatctggctatcccttaacccactcaagttgacacctaaagttaaccatcacagggagacatgctatatccatggactgtgagcctcagcataataaaaatgtcaattctatccaaactgatatataggtttaacacaatttctgtcagaattctagacatatttttgtaaatatatatgactatttttaaatttatatgaacaaagggaaaaaaagagaactgaaagagtcaaaacagaataaagtggaaggaatcaatatacctgattttaagacatgataaagatgtagtaatcaaaactttgtgatattggcagaggaacagacacatagatcgatggtacaaaatagaaaacctggaaacagccccgtacaagtacagacacttgatttttcaaagtagcaaaagcaattcaatggaggaaggattgattccacaagtgaaacagtcttttcaacaaaaggtgctggatatccataaacaaaaaatgaacctcaaccgaaacctcataccatacattatacaaaaattatctcaaaatagatcgtaggttcaaagataaaacataaaactataaaatgtttaggagaaaatcttcaggatctaaggctcgatggcagattcttagacctgacatcaaaagcatgatcaattttaaaaattgataagttggatttcatcaaaatttaaaactttcgctctccaaaataccatgttaaggatgaaaacaaagctactgaccgggtgaaaatatttgcaaaccacccatctgacaaagggttcaaatctaggatatctctctcaaaactcaacagttaaaaacaacaaaacaagacaaaaacttccattacaagtgggtaaaggtgggaaaactcaaactgtttttcctctgcactcatatagcaacaatcaacacagaagacttctgtgaccaaatgtgggagatttcttctccaccaacaagcaagcaatcaattctgcagcagacaccagctgggtgtcctcaatccaattctaatctgatgctatctatctggaggtaacgtcagacaccacggggatgagcactcagtcccatggaacttctccccacttccaatgccaattgcaaggaatgtgcttctgactcactggctatgaatcagagatctcacgacctcttccttgtgtttaattaatttgctagagcggcccacagaactcagggaaacacttaagtttgccagtttattataaaggatatagatgaagagatgcatagggagaggaatggggaagggacacggagcttccatgacgtccgcaggtgcagcacttttcaggaacttgtatgtgttcagctgtccagaagctctctgaacccagtccttttgggtttttacagaagcttcattatgtaggcataattgattaaatcgtttaatcgacttactcttcaggtgaccagtcgccatcctgaagctacggaggtgctcccagccatcagtcaattcattaagacacaaaaagacatctctttggagagtctaaggattttaggggttgtttggcaggaaacagggttgaagaccaaatatatatttcacaatatcacaatgggtgaaagacataaagagacattttatcaacaaggatatatagatagaaaataaacacataaaagatgcttacatcgctaaccatcaggaaaatgcaaattaagatcataatgagatattattactatgtacctaatagaacagttatagtaaaacatagtgacaatatcaaatgctggctaggatgcggggaaactgaatatctaatacattgaaaatgggaatgtaaaataatacacccactctataaaactggttgtcaacttcttaaaaagaactaagcatacactcactatactacatgaaccagcaattgccctcccatgcatttgtcccagaaaaatgaaaacttatgtacacacaaaaaaccgtgcacaaatgtttgtagcagatttatttgtaacagcaaaacactggaaacaaccagtgtaagacaaacttgtcttacaagtgaatggctaaacaaacagtatgcatccatacaataaaataacactcagcaataaaaaaataaattatttatatatgcaacaacttgtaaggatctcaaaggcattatgttgagtgaaaaatcaaactcaaaatgttacatactgtatgatcccatttatataacattgtcaaaattacagagatatagaagaggttagcatttgccagagacttagtatggtgagggtgggtgtcactataatgaggtagcaccagggagacctttatggttatggaattgtctgtattttgactatagtggtgattacacaaacatacacaggagagactgaacataagcaaaagctaggaatattaccagacccagctggaaataatgttcagccgggtggggaggttcatgtctgtaatcccagcactttgggaggctgaggtgggtggatcaattgaggtcaggagttcgagaccagcctggccaacatggtgaaactctgtctctactaaaaatacaaaaattagccagccgtggtggtgcacacctgtaattccagctactagggaggctgaggcaggagaattgcttgaacccagggggcagagattgcagtgagccaaaattgcaccattgcacgctagcctgggcgacagagtgagaccccatctcaaaaaaaaaaaaaaaaaaagaaagtaagaatattcaaacacttattacaatatagacatcgactcttaaattatcccaaattatgatataatcatattcagttgatggggaatagaaagtgttcacgtgtggcattaagtcagcaatggtggagcattatattaccatctgtaattgtgggaagtcaaaagtaacgcctaatactgaaaaatgaagaagtggcaatatgaacatgttatatgagatatggcagtaaaagtctaagataatctattaaaaattgagaatagttgcttctgggagatagaatatggttggatgttagggagactccaatttttatatgtaaaacttatataactatttatttgactcttagtgtgtacatgtaactttgagaaagataaacactaatttagatcattacacgaatgttataggagttacacacaaaggccaggtggggtggcttacacctgtaatcccagcactttgggaggtgaggatggtggatcactagaggtcaggagtttgagaccagcctggtcaacacagtggaaccctgtctcctggcatggtggcatgcgcctgtaatcccaactacttgggaggctgagacaggagaatcgcttgagcctgggaggcagaggttgcagtgagccaagatcacaccactgcactccagcctgggcaacaaagtgagactccatcttaaaaaaaaaaaaaaaaaaaaaaaaaaaaaaaaaagttatatataaaaagaatatccatactattagcactagtaagagaatttcataagctttccagctctaagattgatgttcaaaactcaattgcaatcctattcagtagtcaacaaccactgaaaaaagtaataataaattttaaagattccataaactagaatatattaaaggcgtctctaactaacgatgcaaaagaccattatagagaaaaaaactgtaaaattgtaaactgaacttcataaaagaaaacctaaataaatagaggtataccatgcccataaatgggaagtctcaatactggaaaaatgtaaatgtctccaaaataatatatgaattccatggaatcaattaataaatctaaaaggatttttcatgaaagttgataaagtgagtctaaaatgcatttaagccaagaatagtcacaacaattttggataagaaaaggtgagatgacttgcccaaaagatatcaaaacttactgtggagctatgctaggccaggcacaagcatacctcggagatattgcaggggaatgttgtggctagtttgatcatctctcgagaccactaaaattttctccttatcagcaataagactgtgttgctttcttatcagtcatgtgctcactggagtagtatttttaatctccttcaaaaacttttccttggcattcacagctggctgagtgtctggtgcaagaagcctagctttcagcctgtctcagctttgggcaagcctttttttactaagcttcatcatttctagatttgatttaaagtgagcgatttgcaactctcgctttcacttgagcacttagaggccgttgcagggttattaattggcctaatttcaggccaatgcctctccctgtgcctcaggctaagtagggaggcctgaggagagggagcaagacgggggaacggccagtaggtggagcagtcagaacacacaagacattttccatcaagtgtgctgtttcataaggacacggttcgcggagccacaagaccattacactaatcacagatcctcagatcagatataataattattaaaatttgaaatattgcaagaattaccaaaatgtgacagagacacggagtgggcacatgctgttggaaacatggcaccaatagacttgctcaatgcagggttgccacaaaccgtcaatttgtgaaaaacgcagtgtctgtgaagtgcaataaagtgaagcacaatttaatttgcctgtattgacagagagctagacaagtagatcagtggaacacagagctcatcgaaggaaccacagatctatagacactcgctatatagcaaagctggcagtggatatcagggggtgctggataattaatccttccagagaaaagataagattcctatcatctataaaaaaataagattcctaccatctataatgcatacacacacgtgtgcacacacaccagcagaaaaatataacaagatgtgatggtgtgcgcctgtaatcccagctctttgggaggctgaggcaggagaattactagaacctgggaggcggaggttgcagtgaacctagatcgtgccactgcaccccagcctgggcgatggagtgagactccgtctctgtctcagccagtgtccagaagagcttttcccaagttttcttctttttatagttccagatcttacatttaagtcttaaaaagataaatttaataaaagtgcacaaggtttatattaaaaacaaagctgtttgtaaatgacataaaagacaacatgaaaaaatataaaaatatacagtgatcctgaaaaagaagccccaatatttataccactgtatgtataatataggaatactctggctgtgtacatccaattccctctcccagcctttgtgccattgtatcaggtattatatgatattaatgcgttattatcataatatccacactgcgttattatttttagctttaaacattcacttatcatctatagattttgtttaaatgtcttttaaatttatgcatctatttactttttctgttcttcattcttgtgtatggatccagatttacatctggtgtcattttctttgtgcctgaagggtgtccactagtatttcttataattcaagtctgctggtgatgatttcttttgcttttgtttgattttaaaatacattaatatcggaatagaagaaaggaaaactccttaactctttaacttcctaaaaggtatctatttaaaaaatgcaataaacattcaaaaatattatatatatatgtgtatatatatatatgtgtatatatatatgtgtatatatatatgtgtatatatatgtgtatatatgtgtatatatatgtgtatataatatgtgtatatatatgtgtatatatatgtgtatatatatgtgtatatatatgtgtatatatatgtgtatacatatatgtgtatatatatgtgtatacatatatgtgtatatatatgtgtatacatatatgtgtatatatatgtgtatatatatatgtgtatatatatgtgtatatatatatgtgtatatatatgtgtgtgtgtatatatatatatatatatatatatatatatatatatatagcgagatgaaagggataaatggaaagagtaaaacttaagcaacaattggaaattttttttgtgtaacaaaagctcccaaatcataccaatactgcagctttgtgcaccaagctagaggaacaaggcagactctcccacacatgcccagggaaacaaataaaagaatgtttgttgcaaagttgtactagcaaaacactgaatgaagcttcaaaatctgtcttgagaagaattgataaattgtggcatattcttacaatagaagaccacagaacagtggaaaattaataaaatgtagctccatatatcaacagaaataaacctcacaaactgtgttaagcataaaaaataaagttccagattgctgtgtacagtgtcaaagcatctatataatgttaaaatatgaaaagtaatactatacattgcttaaggattcatacatatgttataaagttataaaaccatgcttgagaatgataaattcagaacagtgttttgttttttgttttttgtttttaaagaactgaagatcataatggcaaatgttactgtttttaaaagataggatgttaggtccatgggtattgtttgtattttttctgtacatttcagaagagaaaaatgcttatgcaacttcccagtgatttcaaaatatatgtgtgttaaaatgaaatcatattttcaaaagccccgcacaaaagtaaaaactgctctgaaaattaaggattgttcatgaccaggggcagaatggaaacttcttttcttgagcagtttaattctcttggttggaagcagggccaatctgaagctcagtacatcagggtcaagacatccctggagtcctcatgaagaaaactcgtccctgactcagctccaaagctctgagggaaggaacaccaggagggtgtgcggaagggagcgtgtccgcgatgggggtggcagggacggaataaaggggtctttagtgacctataagtccttgcagcctctccccacttgaaccccttggagagggctggaggtaatgtatcacagggcatgcaggggctgtagagaaaaaaaaatcattcattcatgtgtttgtttattcatgtattaatttcacaaatatttattgagcacctactatatggcaggtattctgcttagtctggattcgtggcacagatcagaaataaagcccctactcattacaccccaatgccactttctgggttctaaactctctcccatacccacattcatctttgccactagtcagaacctccaagtcccttgaataggttctattcattgattttagcaatactttccttatgcatccccaaaatatatcatatgaaaactgaaacatgtaacagtgtattgggggactctggagtttgggtctcaacattcataccactaccacaccttggaccccctcctcccatctccagggtcccaaagaatggaatttgaaacctttccacctccagggcactacacaatgcacggatctgaaagactctaggaatcgcaaaaaacatttggagaaaataaagagtgttcccaaccttcccttgaggctggatcactcttgagggccccagtgactttgttgggcttgccctgtaggcctcttgccagcctgtcacccagtaccgaagactaaagcctatcctatgttcacctgtcacaggttccacctcctgcagatgtaggtcactgtgaaactcatcaccagcagcaccctgaggcccaggaggaaaaccacaaagacaagggcaggcatctctgggcctcaatgccaaaggatagaaggagccgtcacgtggaggctctgtgagtttaaaagccctctctgaggtcatgtagtcaagaagttctagagcttgcaggttgcacctgattctgattccaaacccatgtcttctctccacatttagtcctctcttggaaataagagttgaccttgacctgtaagcctcaccttgaatttggctcaaatgctgatttgaatatctgacacatagcagccactgtgcaaggctttagaggcacaaacctaagtataatataatcagctccatgtcccgaaggcctgtggtcatttaatataactttgctaccatcttaagagtttggtatcattaggaccattttctagatgagtaaactgaggttatgggaaggtaatggactcagttgcctaagtttccaaagttgtaactactggaaactaaattttaaaataatcttacctgaattcaaataataggtatcaatagctgacatttattatagaccatacgtaaagtttacatgtattaattcatttaatcttcataaagacaatgaattaggaacatttattagacactatctacagatgaacagactgaagcacacaggggtgaagtgcctgtgcaagaatcaagtggaagaggctgttctatcattggagcagacatcatgcaagcaggttttatgtgcactcaagctcgcctccatataaccgaaacaaatattttaaacaagacagccttgctgacaaccatctgagaagcaccagtagtgagtgcactaagctgaactctctcttgggaattttgaaggagcttgagccaggagatcactctttccacagaaattaaagaacctttcaggatggccagatttaaaggcatccactggccagaaaccattctggttatttaaggaatcacagactctcgagtgggataagacctcattgattatcaagctccccctcctcccagtaccttctgaaatccactcaggatacagaagtgaccccaggtgctcacagaagaagaagtgaacttacctgtgctcccaatgggcttataagcggtgtgggctgctgtggacagtacgaggttagcccgtttgggaggctgtccctcatgttccatcatgcaggtgagcacccgctcaggcccctgcactgatgcattcaccagcagcagcttttccagggtgtaggacctatcattattcttctttaatgtgggttgctcagtgcctttgagtgtatggcagtcctctagccaggcaaggtgcacgttttgtggatagaatctctgcacgaggcaagtaacagccaccaagctggaggaggtggaagactgggacactgtcactgtagggggaactgacaaagcccagagaaagcaaacaattattgtgggaagccatctgtaggtgcctgggagctccctgaggatgaagtcatctgcctagggcctaaccagagcctgccacagaggaatactttaggtattggttaacaaatgcacacataaggaaatgcatgattgaatgacagcgtaaattcatgagtgaatgcatgcctggatggatggatggatggatggatggatggatggatggatggatggatcgatggatagatagatggatgggtgggtggatggatgagcggatggatggatagatggatggatgggtgggtggatggatgagtggatggatggatgggattgaagaaagtcatttaatctttcttttctttttcactttggccattaaagatgaaaagatgaggtatgaattccactgaagaagctacaaatcatttaacttactctatgactagataattttaagatttgaagattcatagactctaagtcttagaatccaagatgttaaaattgtacataggaaggaacttcagattatagagattaagtaacttgcccgagggcacaagtagcaaaggtgggattacaccagagacagtaggttttacctttatgctattctaacacccaaactataaggctataagcatttatgattccaggcttccaaaattatgatctaatgacttctagaattttttcagccacattttcagctatgcaatagaatgtattcacaataaggaaaacaggacaaatttgaagtcctataaaacactaaatatttcaatagacttcttatgaacacacaacacgatgcagctctaacactaaactgagggctgggagatctggattctggtcattgcactgataccatagccaactgcgagacctgtgcaagtcactttccctctgtttctaagactctaaaatcatgaaattctctgaggtcagatcagctctcatgggcctagttaagagagatttcagctcttggtctagggtagaggaagcaactctttctgtagggcaatttgaaggagttacaggaatccaattcccaaatattcttttctcatcctcaacctacccagacttgtaaaagtctatcaatgatgttgctaatggcagctgaggcagacaccctccctgagcttattacctgcacttagtctttccctttcagcacacagggagagcacagggatctcaccaagaaaagagcaaaacctgagaatggaagactccgggtgttgaagccctggtaactggggtggtgcccgtggagaagagggcagggtaaggtgccctccacacaactgtcatgggttctagaaggtgggaaggatcaaaaaaaataaaaaaggataagaggctgagaaggcccatttcaaccgccagtgagttttcctggctgtctggtgtccaggccagtgctgggaggacaaaggcctgagcacggctgatgacaactgctcccatcccctgaaagtcaatgtttgaggcagtgtgcatgcattctcttattcaattctcacaaaaccaaataatgtaaacactgaagctacttggtgtcagaaaaaaaaggtgccacttagaagcagcctatacaaaatcaggcctcaatttcatagaaattgtaaaaaaggaattggttggaacgtcatcttgaaaagcatttaaattttaaaaaatttacttaatttatatttgcatataaatatatagtataattgcaaagaggcaccaactcttataagaataattgttggaagtggacggaagctggcatcattttttttccagaatttatactatagtaccaacaaatccttcatttcaaatctcacatttatagcacaatcattaaagagtaattttgaaaaatcatttgaaattatttgagtgttctatcaattttcataggggcatcttttaatcgaagggctctcttttgaagtgcccacagtatcattagcatcgtgaattttttcttattattatgattccatttttaacactcaaaggctttgcctgtgatccctgcagctccccaatatcacctgcctcaacttcttgaaatacaactttttcaagatctcagtttgcactttgcaatggatatggattctatttgcacaaaatggtgtgaggtttgccacacatcaatcaaggcaagaccaacctcctacagcagagggtttctgggctccacgcctcctctcccagctgcctgacctcagcgcactggtgcaagacagtactactcacaccgagtcccaccttgggcttccaaaaccctttccttttctctgcctcagatttctctgtaaacacgaaatgccacctccccactacaggcacatccccacctctcctccttcatgagacaattctcaggcatagtccacccagttcttcagagggtctccagtgtcattgggccccagttttccacagggccatccagctcaataactcactctttcttggccgaccccctgcaaagctagtatctctctccctgctccctcatcccaacctctcagcatcaccctccaaccacctacccccaagtcctgggttcaggctctgctttcaggggaacccaaataaagatacccacaaagatatttccatgagaggaagcacagccctgagatgcatgcagtgttgagtagggaggggcttggagtgggagctaattttatatgtaatcgatttatttttgaaaatttgtattttctataacttttgcttctcaacaccatcgtcctagctcaggagaattacataataaatactcagataaggaagattccctgaactatcatttctctattttacagacaaaaatactgaggatgggagaacataagcgacttgcagcagatcccacaactggtaaatagagcagagttggaagctggaattcatgccaaggtttctcactcaccggctttacaaccttaagcagccttcacttctttgagcctcagtttccttctgtaacccacaaatggcacaaacagtatagggaagttctatgcattgaagtccattcacatgagtgtgctttactgtctgcgtgctgtaaatgtttgagacattactaccaatattttctgccatgtaacatgatgtgtttacttcccaatagcacaattctccccctgttttgtgaatgagaaaatgaagagagatatagtttgtagattttaaagtccaatatacattcaaggaattaattttactgctatgcaagcttggaccactcacttgccttctctgacttttacagttgtcagaacaatgggatgacggttaagatttcttctaggcatgatactttatgacctcatggaattcacagatctaccaagcattggtccaacccgtctaaagacaccattggccctagaatttagtttcccaagctcttcaaatcttcttcctataaaataatgataataataaaattgaattcccagaagatatcctgtctccattttacagatgaaagaagtgagttctgagaagtgctgtaaataataataataataacaattgccacttctgagtagttagtatgagcaaggcactgtcttacgtgctttacaggtattatttcactaaattcttgcctcaatcaaacaagggatgtgcttgcttatcattgaaggttcttcttcatttttcattgaggaaactgaggctcagagaagtccccaccccaactctgcactacctcagctgagcagagagagagatcttaccctggaggtactggtccaggccagtggttttctggaaaaaccacgtcaacttgtgctccacatggcaaacgacgtgggagaacacatcatcatccatcagcgggacaagcacactgctggtcacattgtaggtgtgtccactgtactggacgctggtctgggggtttgggagctcgtgtttgtttttaagccaggtcacagtaacctggtgtgtcgagaacccagaggatgcataggtcaatcggatccttgtgccaggctcagatcgctgaagggggccttgcaacttgtaaggctggacactctggcctgcaaggatagacccctcccatgagagggcacagaggtgcctgaaccccagtgtgaacaaatacacagcatctgccaagaagcccattgcttcctctttcataagatgtaaaggttatgttctgataggaaccagtttctgaatctgataacggaggccggacagtgaaactgtagcaatgggcaacagcagtttgtaaggaggtcaactcctacagatactgcatagcgaacactcacttggcacctaccctgcctacaggctcttccctaagtcactgagttctcacagcagccctcagaagtgggtgctgttactatccccatttcacagatgaggaaactgaggccaggcaggctaagtaacttgtctaaggtccatcagtcagtggcagagctgggatcttagccaggtagtcaggctccagggtcggcaccccttactgtcactcagccctaccctcagtctttgaaaatggaagaaaacctcatttctcagaggctgggtcatggagaagaggctggaaccatggagaaaaggttaggagcacaggctttaggatctcactcaacccaagtttacatttccactctccactgaagcccaagcaacttaactctctgagcctcagttttttcatctgtaaaatgggggcgattttttttaatagaagaagaatggcttaaattttataacaactattcatcccattttgatatctggagtataattaaattcagacttcctttgtttatttagccattagttttgatgaagtacatttttcttttctttctttttttaaattttattttactttaagttctgggatacatgtacgtaatgtgcaggtttgttgcataggtaaacatgtgccatggtggtttgctgcacctatcaacccgtcacctaggtattaagccccgcatgcattagcttttggtcctgatgctctccttcccctcacctgctgcaacaggcctcggtgtgtgttgttctcctccgtgtgtccatgtgttctcattgttcagctcccacttatgagtgagaacacgtagtgtttgagtttctcttcctgcattagtttgctgaggatgatggcttccagctttatccacatccctgcaaaggacacaatctcattcctttttatggctgcgtagtattccgtggggtatatgtaccacattttatttatccagtctatcaccaatggacatttggattgattccatgtcaaggaatttattttactgctttgctattgtgagtagtgctgcaatgaacatacgcatgtatgtatctttgtaatagaatgatttatattcctttgggtatgtacccagtaatgggatcgctgggtcaaatggtatttctggttctagatccttgaggaatcaccacactgtcttccacaatggttgaactaatttacattgccaccaacagtgtaaaagcgttcctattgctccacagccttgccagcatctgtcatttcttgagtttttaatacttgccattctgactggtgtgagatggtatctaattgtggttttgatttgcatttctctcagagttaattaataaattaagtgatgtaactagtgtagaatatgtagcacacagtaatcactatataaacggtagccctccgcaccatatactcacaatgaccatccaaggaattattattaatcatatttttaatattaacagataaagaaaaggctcagggagggttagtgactcatccaagggcctcacagtgaacagaactgacattgtaacccaggaattctgactccaagccaaggcctttttctgttacatcatagctgcctctacttctgcacagttggctctatattaaccaatgacctttaatattgtcctacttgcagctcagctctgggctaggcactgtggaaactgcaaacagtcactgcagagaacttgctatgggccccattgtccagatgccaagcaggagtcaaggaaaggaatcttaagcagggctctttgaggtgggtataacaattgtcattacaacaatggaaaacttgactcagaaagggagttgcggccaggtgtggtggctcacgcctgtaacccagcactttgggaggccgaggtaggtggatcacctgagttcaggagttcgagaccagcctgaccaacacggtgaaaccccatctctactaaaaatacaaaattagctggccatggtggtgtgtgcctgtaatcccagctacttgggaagctgaggcaggagaatcacttgaacccgagaggcagagattgcagtgaactgaaatcacaccattgcactccagcctgggccataagagcaaaactccatctcaaaaaaagaaagggagttgttttgtcttaggtcacatggctggggacactgatctgtttgactccgacgtttggccacctcgaaacataagagccagtccctgcttcaaggatgtgagagtctaatcacggaagatgggtgtaaatggaataaaaccccaggtcgggggactttgggaacgcccttgtagtttaaatactaattgtgagaactaactggtatggaccgataagaccacacaattcaggaagaaataaatatcagaaatagagcatttaaaattgagatttgagaagagacttgagataacactaagctttgtattctcgggcaggataggaaagaaaaatgcagaaaaacacattgaatttttgaacagacacgcctgcattctaaccccagctatgctgtttggaacctctgagaccttggtccctgtgctagctctgggctctgttgtaggatcagataatgtatttgaggatgcctagtgtgcagtaaatgctctacgggtgtcacccagtaggaacagagacagagtggggagttcgtaacaggtgagggtgctgatgaaggcatttatgggccaggttggggaaggatagctgcaatgctttgttaacaccaaatagaaaggggcctaaatgccagaaaaggaaggggctgcccttccccctgcagaccacggggccccacaaagctgcatagcggagccatataatcaaaaggatgctcccagggggttaatgttgcagcagtgggccagatataccgcatgcaggcaaaagagaaaaataaaagaagaaaaaaccagcatgagtcaataaagaagtatcgtaacttgcttctgatcagaaaggaccagttttgagtttttcagccagacctgtatatcctgctgggtgagtgtttttcttctctctgctggacaacagacaaaaaggcacggggagactgaaagctgagtgggatcattcctcttaagaattcttacagcagccagataagaggccaattccgtcagggagagagagaatgcgaggtggagggccctggtgggaagatgggctgttgttgccggtccggcacccttaccctggcagcggcctgcgctgtaatactccgaggcatccaccctcactgcccccaggggactgtcctttttgacttcacgtggttctggagggctgtgggtccataggctggcttacccctagctcacaaggcccggccgatcctaatgacctccacccaccctctcggacactgagcgcccccaccgcccagccggcccactctgggccagtaattcattctcccgagctcatcccagcctctgggccggtagttcattctcccgagctcatcccagcctctgggccggtagttcattctcccgagctcatcccagcctctgggccggtagttcattctcccgagctcatcccagccgggcggaaggagcgccgcccgcgctctctgggtctgaactgccggccgacagctccctcttgtggagaaaacggtttgaggccgcaaagagtgagcgagagacggaggcagagattccaggcggcaaggcgggccagagaaacgatcagcacggccaacagacgacccacaaaatgggagaaaatattcgcaaagcgcgcatccgacaaaggtcgaagatccacaatctataaggaacttaaataaactaacaagtaaaaaaataacaccattaaaaagtgggcgaaggatgtgaacagctacttttcaaaagaagacacacccgcggtaaacaagcatgtgaaagaatgttcatcgctaatcattaaagaaatgcaaattaaaaccacaatgagataccatcccacaccagccagaatggctattattaaaaagtcaaaaaataacagaggctgtacaccaaactgcccccaacacagtttacctatgtaaaaacctgcacatgggcccagacctaaaaccaaagttaaaaaaataataataagataatataaaaatactcaaaaaagagagaaagtgaagaggacaaggaaaaagagaaggatggaaggagaaggaaagtgagggggaaaaggaaagggaaaggaggaggaggatctgtttgaccccgtgtaagggcctgtcctgaccccatgtaagggtctgtcctgaccccgtgtaagggcctgccctgaccctacgtaaggccgtgcatggaccctcttttccagctgaattcagaattctggcctctgtttaaagttgccatccagaaactttcaactgtgccagtcttgattaatagcctttctagaaggcactttggtgctcagcagtccttaacctctgccatttcttgcagtcaagtgttaaggtggagaactttcaacatcaagaatgcatggaattagggaaggggagtcccaccctttcttcttggggagggtgtggaggaaggcgtgagaagtggagtctgggggcgaatgtgtgagagttgtatcaccagctgcgggtatccttccttccttcaccatcatccaatgccgccctgagtctctgaccctccccagccgtgctgcccacaggggatgtccagaggggctgggccagaggctgtacccacctttcccctgcctgcgcacctgggcttgcagggtgacgttggccttgagtgggggctgctcatcgtggaccacccagcaagcaaactcacgctcctccagcgtggcctctgcctgccacgtgtgctccagagagtatgtcccatctggatttctggtggcctgaggggacgaggggacaccagggtctggatcatgctcctgttctccatccaggtgagtcgcaggtgggcgggatagaagtggaggacgtggcaggtgagattcactctgtcttgcacatgtacatgggtcccagaggtttcagtggtgatcttcagggtggggacaactagacagaggaataggaagtaagacctggtgaaatcagcccctgcctgtggccacccatgcttccctctcccagggaacagcctcaaggtctctcgcctttttttaaagaaatatttttttcttgtatgcgtaatgtaaagcaaatagggctaaatgttaatattcattaaatatgggtaagggtacctgggtgtctgctatattctgtatttttgaaatatttcatatcagaaaatataattttaagaattagtaaaaggtgatgcccatgacgacagggactttattttgctcgttgctgcatccccagcactgagcacagggtctggcatacagtggatattcattattattaaatgaataataaacatttaaaaaaaaaactgtaacaatgacattaatagaacaaagatgtttagaaagggagtctgggaccagataataacaagatcaaacattcgtaagtaagtcactgcatgccaggcactgttatgtgtgttttataaggaataattcatttaatcttcacaggacagctatgaagtaggtcctcatttttttcctgttatataaagaaactggtattaaatagtcaagtaactcacaagatcccacaagttgtaaagtggcacagctaggattaaaacccagacagcgagcccctggaacctgcgcttataaccacaatacacatgatcagaaatccatgaggaatttcatttccccatttatgaaatgaggctttgggcaaaaaccctgaaagctggatgcttccagggttaatgtccaccccacctgactgcccattcacctcagagcacttgggagagattcatggttgttttcaggggctctgccagggccctgtgggtgacttcgcaggtgatctcagatgagacatcctgtcgggtcagtgtcacccatgccttgctggtgatgaagtcattgcctccattgtcaggcaccaggcgctgagctgaggctggatgttcatcactgtccttcaaccacgtaacattgaagtcccgggagaagtcctgggagttgaaggggacagcagtacagttgaaaggcactgagtctccagggcttgtcctgtgagatggaccagtcagagagatgaagggctgtccagctaaggaaagagcaattgtgattgtacactgagagtgggacacaccccacaggcaccagtggcaccagagctgtgtcaggccctgggggcctactatatgctgtgtctgattctgtcttcaggcagcatatcggcatttgatcataagaaaacaagcaaatgcaaatgtgattatgactgatcccagtgccatcaaggaaacccaaagactgcatagatggagaatacagggaggacttattctagaagggcagctggggaagaattacttgaggaggtgacatcattgagctgaaactcaggaatgaataggagccagcaatgggaagggacagaggaaggacattccagacagcggggacagcaggagagaaggacctcaggcaggaagggcttggtgggcttgagaaactgagaagtctgtaggggaccctagtgtcatggcaaagaggtccagagtgagaagagcctggggaccatggtgatgatcttgattctattctgagagtgatgggaaaccagcagagactttaacagaggggcaaagtggtctgatgtacattttttagaggataactggggttgttgtgtggagaatgggaaggagcgtggcaggaatggaagcagggagaccagtggggaagctggtacagacctccaggccaaggtgatggtagcctggactagggtggtgagaaaaggaggctcgagacacatttggaagatacagcccacaggactcagtgatgggcgggatggggggtgagggacagaatgaattctggatcaacaattcccaggttttctctagagcagctgtgtgggtggtagctctactttttgagctgggaagatctggagaaggaccaagttgggataggaagggaatggtgatgaatcaggatttccattgtggatgtaagtttataaggacttgagtgtaaagtcaagaatcaccccaacagggatggttggcccccctactcgggtgcctcccatcaacacttcactagacccccgttgtctgcttgcttacctgcagtgacagggagctgtctccatgagaagcagctccattcaccctcacacccagctaggactatgacaaaatatttcctgcttctgggatataacctgggatctgtctcccagaattttcccaggaaaactgcaggatgagactcacccctccttctaaggacagccttgcagagctctggagcaagaaactccccaagtcttcacagcattccctaagcccctgctctgcaccaggtcaagagctgggtgctgagaccacagagatgagtcagacaggacccccacccttgagaagcatctggtcagatgggggtgaaaggcaaataaacaaccaatgacaagcaggatgacaggcagagggcagcgcaggaggccataggaacttgtcctcttagcacacagctctggtaccttctggactgtgctctgccctcatcacccaccctgcacacagcaccgtgtggttcagaaaacattttcagccatgtgtgcttcttttcttccacatctcagctgtgggaggctggtattattgtcctcactttccagaaaaggaaacagagattcagaaaggtctcgtgacttgctcaaggtcacacagcctatcagtgactaaagagggagggtaagaaggcctgtctgactttgggtccaggactcttccatgcctccaatgccggaggctccatcactctggcgacttctctctctctcttttttttctctctctctctttctttctctcgctctgtcttttccacccttacaccctctctgacccagaacaggtagccacccagactagagctgacatcgggaaaactgggaggtgggctcctcttttaccccctgacctcccccgagcccctcacccttaggtcacttcctcttctgacccccaagctcccaccagctccctttgtccgcaaggtctacattgaagaaaagatgcaaaacagcacctgactggcaggaaaacagctcagtcacctcctctgagcctcagtcttccttcagaaagacacagtggctggatttggtcattcctgggggtctccttgcctgccctgagggtctctctgggcaggaatcaggactcacctgtgagtcccagcagaagggtgggcaggagggagcccagggcccgcccaggtgtggtagccatggtgagagactcacagtgctcctggtctgttcctggtggcaaccactggataaggccctgaaagagcccaggagccactgaccagcctctgacagcctggagcaggccttatacttcccagctgcctaccccaccccattctctgccatgcctggaacagaggcctgagccacagtgagggaagtggtcactgtggccacggcctccttccaagctgcaaaccttcaggcctgaggtgtctaaccagggaggcatctggagccttttaatgggttccgactgtccctgattccccatgagcaaaaccagaaagcggctgagctctgcctcaagcttcaagccacagagctggcctctgataggctgagccttgatgtcccttgtcctggaggctcctccatgctgaacaagcagcatcaagagcctgccctgtcccaggcccagacacggcttctgggaatgcagaatggatcagatatgggcccagagggttgagaagtgagccttgacatacacaaccacgtgcaaccaagaaagaccctagactttgaaacccaacccttgcctcacagcttaactgggcttggacaatggtggcacggatttcccatggcccagaactgtctactaggctccacgttggggaaacatgagtttgaaacacagccaccagtttccctgacctccctatgaaaacaacctctccctttggtctctctccatttccttaccctacgttactgggctttccaatggttagccctgatgtatattactcgtttttatccatttccctcatgaaaaacaaatgatttgccctgaagactactgctttttgttcatggctgtaaccagcagccacacagtgctgggcacagaatagatactcgctaataacaaatgaacctttggggccaggtatgttctcaagactgattacaaagcagccaagcccagcctgctccccagccatcccatctctttggggtctgtacgctcagctaaagtggagggagaggctagagaggagttttctagcctgggtgaggctgttatggaaactcccctgacctcacaaccccccaccactactcagccaagcaaggcaccccaaaatgactcctagatattacgtgcctgcaggaggaggaggctggcttttctttttccaggtgtctcctgaagcaacagtggatttgctgatccaccttgatgttgccctgagcaggagaaaaaggaactgaaaagagacagcagggtagagtgacggggtggcagggcagcagctcaagcttcctccatgcagagtggcaagggggtgaggtccatggagagaccctcattgaaaggggggagccgaccttagagcatcccactcaagagagatgaccactggcaagagggcctaggagtaagagactgcagcatggactccagcggggagctgtgaacctggatcagatcatgcataaaagagactgtgcagcagactgtgtacccccacagcatacacacatgggcacacacacgtgcacatgcatgcacacatgcacacattcaggatcctcctaggaatccacacctgtgccctaggaggcagctggcttccagagtccagccatagtgaacagagcattgctgggtaaaagaagtccctctttttccatctcccttcccaggccctaacacaccagatgatagacagacccaattcagggaaaggaggagggacaaaagaatgcttcacctccatcccttccagatccctcagcagggacttggaggcagcagtgggctggggtgagagaaggaagtggacgctgaactagatgtaatgttggcattttcaaccagactagtttggactgggcagggcctgacacagaatagttactttataaagtttggtaaaattattcatctaccctcagttccttggtgacactagccacatttcagacactcaatagtcacgtgtggctactggctaccatagtcgacagtgaggtcttgggtgaaacattcttcatcagggaagtcttttctaccctaatgtctccctgtgggttcaaatacttctcttgcagagcatttatcacagttataattaaactgttaacttgaaactagttgcataataactctttcccttattagactgtaggctctggaggacagggaccatgtccttggtcactagtgtaaataagtgccggatgaatgtttgttggatggatggatgggtgggtggatggatggatgggtggatggatgggtggatccatggataaacagactaagaggaaggtatgtgctacagggcaagggacagaaggaagcaatcccactgagaaagcagagaagccttcctggaggaagtgggcttccttcagggctcctgtctcagccctccagcttaatcacaccatctacacagaaggagaagactggcaacactagggctaagctgcagtgggtgggcagccatgggcagcctgccttgtggggctggaaggctgaaggggaagtggagaagatgaggttctccaaggagtggcctgaggaatgccaaagtacccacagggctagcccaggctgggccatgcgtccactgggtaaggcttggcttcctctgagtagagtcacgtcagtctccttccttattctagcaccggcaagaactggctgtcacgtactctataagcacaaccttttataggagctggggacccaagagccctcatcatgaatatgggcccctgtgctggcctaacaggctgagggcccagagaggacagagagttgctagctcttcagaaaagggacactgggccaggtgcagtggctcatgcctgtaatcccagcattttgggaggccaaggaaggcggatcatgaggtcaggagttcgagaccagcctgaccaacatggagaaaccctgtctctactaaaaatacaaaaattagctgtgcgcggaggcatgcgcctgtaatcctagttactcaggaggctgaggcaagagaatcgcttgaacccaggaggcaaaggttgcagtgagctgagatcgcgccagtgcactccagcctggggacagagagagactctgtctcaaaaaaaaaaaaaaaaaaaggacatcaatgaccctaaaatccaactccttgctgcaaggacccatggatcttttaccctcaccccatcttcttagacttacccttgacaagctgcacatgtcactctgagcctcctgcgaacacaagtccgtgtctccccaagacgatgatcagcctccttgaggacaggaacccttccttgtccacttgctccatgtctgagacctcagtgcctcacacagcccctaacactgaatagcccctgaacatgcatgtgttaaataaatgtgtttcgttattgatttacttattcctgcaattctttatagagtgtcaattatgtggcaggcatcatttggggcactgagcaagtgagcagtgagcaagatagtaaaaataaaggaatacctaggcagtataattccagggaggttaactggtatgaagaaaaagaagtcaggggatagacagtagctgcgtatattttggaccgtgtgcacaggaagccttctctggggaggggcctatgagctgagacctgaatgaaggaagtggaagtcatagggagttctaggagaagaatgttccagagagaggaatacacttgcagggcaggcatgagctgggcatatgtgagccacagcaaggtcactgtggtgggagcagagtgagggaacagatggtcatgggagaaactgcaggacttgatcttggaggctgtgctgatgaggttagagtgtaatctgtgtgcagtgccttgggcagagagcagtaccggagcaggatccaggtcacagattggaaactcacactctggtggctgtgtgtatgtgtgtgttggaggagggacaggctggaggtgggtaaggaaggaagcaggggagaagaggaagcaagaggccactgcagttagggatggctggacacaggactctggagctgggggagagataggtgatggagatgggggatagatatttgcaagctgtcaacatgtggatggtttccacatggacattgcataggatgagaccacctcaggaaagaagagattgggggagagggagagggggaaggagagtcccagggctgggattctgatctggctctgccaccaatttgcagggtcagcttgggccatctctctgggctttgggttctacaactggacatgaagggaactgagccaggtgatctctaaggatccttcttctttgaatattcacaggcttggtttcatttcctgtacccaggagttttagtctgggccggggctccactcaccccactgctgagcctgctggctatctgatccctgcattgcacagggccccactctgagaggaacccgcacttgatttactgctctgctgttactgttttgaaacgtttaattattctgggacatgctctgctaattatgtggccagtgctaccatgtgccgttggtctactgctgtgaggtgaggcaggagcacgatttggctgttgggaggtccctcaggttgttgggtgccaggactgagggcccttgctggacccctctgaggactccccagtccctgctgtcaccaacgccaccctcccaatgcctccccagactctgcaatcccagaaagacaaccttggcattcctgaacttccttttcctctttccttcagaagctgaacaaatagtcaagggcaaataccaaaaccgtggaattctgatatagaccaggatttccgaagatatgagccatggactgacatgcagacacagtcctaccccagatgtagaatcctacagaggtcctaaaatctgcagttaaacaaactaaacaaaacagcattctgactgagttaaaacttgagaactgctgatttaagctagtgacccagatgagttcaggaagatgacttgatgggggcattgatgctgcctggattgggggctggggagaaggagggaagccagggagagatgaactactcagccatatgctccttgtccttcaggtctcagctcaaatgtccgcccccaggaggccttcccttgactccagcacacagtgagctgagaccctgctccaagctccctcaactcctgaccttagcagagcaccttcttaccattggtgattgtcactactgctagactgcgtgcaccgtggaggccaggaatggggactctcttggtctccatggtatccgcaacacctagcacaaggtgtagcacacagaagatgctcaacaaatacttgttcgatgaatgaatgaagagagagtttggatgtatagggccaagggaatctttcagtcctaggaatctgacacttaccttggagtgaaggctggttactgcctcttgcctgaggagaccctatagagggctagcattagaattcccctctcctggctgatcttagagtgatggaagagactggcaggggaaaatttagactaaggtgttaaaggctaacataccatttcacccttcaatattggttgtgatttccaaaatgctatttgctaaccccactgagcatctcactgggaagatccaagccattgaggaaagaaaacaagcaaaagagatttaagggttaaagaaaccctcttttgatattttacatagtcccaacaaacttctctgctgcaggagatgaagacttcagccactacaggtggactggccccagtgacccctgtctccatgagagcaagcagatataataatgggagatgatggtgaagatcaatgccttaaacccgaagaatggctttaatggtggacttttaggctgtcagcacttaggtggggcacatctgtaggaagaggagaagaaaagaaaactcaatgagatgaggtgatttgcttgataacttacagagagaccagcaagctagataggaacaactaagaccaataaggaagttataagaggctcatttctgcttaagagaaggaagaactttctaacaataaatgctgtccagtaacaaaactgtttatcttttgggggaacttcctttcatcagggaagtataagtatagaactccagttagagatgctggacaaggagtctaattcgactagataagtgattttcaaaccataggtcacaatgccttcatggggcatgaaatcgatttagcggacctaaactagcaattttttttaacggaaaagatagaagagagaggaaagaaaagaaggaaaggaggagaagggaaaagttagaagatagaaggggaggtgaggcgaggaaagagaaaagaagaggaattatgtgagtttatcccacataggaaaggcaagaactgtccactgaaactttcggggtgtgtgtgtgtgcgcgtccgtgtttgtgtgtgtgtgtgcgcgtgtgtgcactcactaggtggcaatataaagtatattactaagtgtgggtgatagtcaaaaagattgaacacctccggaagttgatctctaagatccttcaaactttgcagttatgtgacatgaggtccttaggttttatgtatcaaattatgagaataggattctaagatccatttatttcattttttattcatttactccacatttatttaatacctattttaagccatactgggtgctaggggcaaagagatacatcagaatcagtatcagttcctgccctcaagatatggagatgaacatttacacagatcattataatacagtgtagtatatgcttcagtaagcatttggctaagatttatgcacctttcacccagccccctgtgcaaactgattttcttatctccattttacagatggaaaaaaaatcaaagctcaaatggtcacacaaagggtgaatcaaggtccacccagcagaaccagaatttgaacctaagaccaccaggagagcctgaatttctaaccgttgggctccactggggtgtgaagggcaggtgggtgggatatggaggctcagagaaggaaggctggctgcagcagctgggggtggggtggggaagaggccagggaaggcttcatagacaagggatcattgagctatgtcttgaaggaagaggagttggatggcttgacaagggggcaaaggtgtcaccttccatacaaccagcagaagccgctcgaagaatagtaaaaattgtgggatgtacagcaggcagacctggtgcgaattttagttccagcttttactacctgtgtgaccctggacacgtcacctaacccctctaaacttccatttcttcatgcattacatgggagttattatgaaatgagagattacgcacccaatgcatccagcattagcacagtgcctggaaaataatagaagcctcatgctaattacaacctatttatgacagtttgctgcctatcagctgagtaaccttgagcaaactgctaacctctctgtgcctcacttccctcatctttaaaatgggaatcataatagcacctatcacataaggttatgaaaataaaatgaatacacgtgacatgcttagaagagtatgaggcaaaaatcaggtggatgatagaggtaggtcactgttaatacttctgtgtgctacacaccgtgcagagagttttaccattttatttattcattaggttaacaaatgatcattgagggtttgctaggttccaggcaatattcaaggtgcagcagagaatacgaagtaggttaggacaaggctgcagccctgggtggaatttgtttgctggggagtgggagggagaataggatttgggcaggaggtgagataagtggtgagaaatgaggctggagagatggaacgggtcagagcataaaaatcgttttatgtcatgtcgtcctataaatagtggtgagtccacggagattttcaatctgggggacttttcttcttagaatttacgattctccagttgtaaaactctatgactctacgtgccaaagtctttttgattccaagattatagtcctatggttttgtgacttttaatatttcttacttgctgtagtagattgatattaaaagtccccacagtggggacttttggtttcaactctgacatgcaaagaacttggaagtcgttactcctgaccttacaacaagaaaatgctggatatgctgaaaatcaatgactttccttgagcccattagaaaactgaggttgcagagcaaactaccacctaaaaatctggagaatcagatgagtccagatagatgtgagcccaaagttctgcttccctgcagcaaggcctaagtcagccagtgggaatgcttacacagtaattctgatgaattgccaaggctacgtgcagactagcatgggagggagaagcatgagagggaagacctcacactcttgcaggtttttcctccagaaagctcaccaagttccaatgagaaaggtccccacgtggcccgagcagggagatgcaatgaaagctatggtgaaaccctcccaggatctcttccctcattgccagagggaaggactttggcagagggcacttctgaaactctatcttagctaggctaaaggagctctgcatcactccaggcctctccagacttcctgtcccatctagggaggaaaaaagtggtggcaggggagggagctctacccctgcaggaagaagaaaaacacttctaaagtccacactcctgaagcaagaggccccagattgagacttaattagaggattagggaatgccctccgtcccccacactctagcacataccaataaggctccagtagagtacagtgacttacagctacaagacacagactctctgaggagctgtataaaggaaagctccagagccaagagaggagaaaataaggacattaaatgaattggaagtccctggtgcctataactacaacaagcattaaatgctgcccaactcctagctagattaacatcaatcctcacactaaaggtctatttacctcagtgtttattttcttattcaacatgtccagctttcagcaaaaatttacaaagcaagctatagaggctgagcatccctaatctgaaaatctgaaatttgaaatgctccaaaatctgaaagtttttgagggccaacatgacaacacaagtggaaaattctacacctgatctcatgggatggtctgcaggcaaaacacagtcaaaaatttgtttcatgcacaaaatttttaaaatactgtatagcttgttgcattggcatgcacctgtagtcccagctacttaggaggctagggcaggaggattgcttgatcccagcagttcaaggccagcctgggcaacataacaacactccatctctatatatattttacacacacacacacacacacacacacacacacacagagtatatgtgtgtattttatacacatagtataaaattatacactataattttatatgcatagtacatagtattagtccattttcatgctgctgataaagatatacccaagactgggcaatttacaaaagaaagaagtttaattggacttacagttccacgtggctggggaagcctcacaatcatggtggaaggcaaggagaagcaagtcatgtcttacatggatggcagcaggcagagagagctctcacagggaaactccccttgttaaaaccatcagatctcatgagatttattcactatcacgagaacagcatgggaaagacctgcccccataattcaattacctcctactaggtacctcccacaacacgtgggaattcaagacgagatttggggtgtgggtgggacacagccaaaccatatcacatagtataaaattatcttcaggctatgtgtgtaaggtgtgtatgaaacataaatgaattttgtgtttagacttgggtcccacctccaagatatgtcattatgtatatgcagacatgcccaaataaaaaaaaataaaatctagaacacttgtggtcctaaatattttaggcaagacatactcaatctgtgttagttccccaaggctgctgtaacaaattaggacagggtgggtggctaaaaacaacagaattttattctgttaatgttctggaggccagaaatccaaaattagaatcactgggccgataccaaggtgttggcggggctgtgctccctcttaaggctctataagggagaatcccttccttgcctctcccagcttctagtagctgctggcattccttggtttgtagccaaatcactccaatctcttcctgtctggtcatgtcacctcctcctcttctgtgtatcaaatctccctctgtctccctcttatatggagacatgtagaaagaagtacaaagtaggaggactcacactctcaatttcaaaacttaggataaagctatagtaattaacacagtatgataatgacataaggttatataaaccaatatatagacatatagaccagtgcaatagaattgaaagtccagaaataaccccataaagtatagggccagggtgttaagtccagtcagtgtggaaagaatagcctcttcaacaggttgtgctgagacaacaggatgtccatgaacaaaagaaatgaagttggattcctacatcactccatatgtaaaaattgacccaaaatccatcagagcctgaatgtaaaagctaaaatcataaaattattagaagaaagcatagttgtaaaccttcacaaccttggatttggcaggggttgcaaaagcatgagcaataaaagaacaaataaattaattaaaattaaaaactttggtgcatccaatgttatcatcaagagagtgaaaagacaacctatgcgatgggagaaaatacttgcaaattatatatctaataatataattattagaatatattaagagctcctacaactcaacaattaaagagacaaacaacccaattaaaaaatgggaagaggacttgaataagcattttcccggagaagatacacaaatgtccaataagcacaagaaaatatgctcaacatcattagtaatttaggaaacacaaaatcaaaaccacttcatacctaagaggatggctatttacaaataacaactaaaaaaaaaaaaaaagaaatggcaatgatgtggagagattggaacccttgttcactgatagtgagaaagtaaaagggtgcggccactgtagaaaagttttccagtttctcaaaaagctaaacatagaattgcatatgatccagcaattccactcctagctttacagtgcaaagaattgaaaacagggactatgatgcttgcatgccaatgttcattgcaacattcttcacaatagccaaaagatgttttggctgtcgtgaaaaatcaagtgtccatcaacagaaaaattactcaacaaaatgtggtatatacatatcatagaatattattcagccatagaaaagaataaagttctgatagatgctgcaaaaggatcaatctcgtaaacattattatgttaagtgaaataaggctgatacaaaaggacaaaacgtgtataagtccacttatatgaaatccgctttgtgcatctgctttgttaaacagtttggtgattctttgatatgctaaatatacagttaccatatgactcaacaattccacttttaggtatttacctaagggatttgaaaacatatatccacacaaaaactcatacatcaatgttcatagcagctttgttcatcagagccaaaagatgaaaataaccctaatgtccatcaactgattaaaaaaatgggatgatgcaataaaatatgacatcatacaatggaatattatccagtcataaaaaggaatgaagtagtgatacatggccgcagtagcacgcacctatagtcccagctacagaggaggctggggcaggaggattgcttggatgaacatggatgaactctgaaaacattataccaagtgaaaaaagccagacacaatatagaatcacattatatgattccatttatatgaaatgtccagaacaggaaaattcatagagacataaagtagattggtggttgccaggttctccagggagggggaatgggaagtaattgctaacgggtgtgcatttctttgtagggtaattatatgtttctggaattcttgttgataatttcacatcttttttttttcttttttgagatggtgtcttgctctgttgcccaggctgaagtgcagtggcatgatctcagctcactgcaacctctgcctcctgggttcaagcaattgattctcttgcctcagcctcctgagtagctgggactacaggcacccaccaccaagcctggctaatttttgtatttttagtagagacagggtttcaccatgttggtcagacctcaagtgatccacctgccttggcctcccaaagttctgggattacaggcataagccgctgtgcccagcgataatttcacatctttgtgaatacactaatcagcacagaactgtacacttgggaagggtgaattttatggtatgtgaactatatctcaattttttaagtaaggggatagtatactcacactaatcaaaaggatactggagtagctattaatatattcattttagacaaagcggactttagaataagaaagagtatcagaactaatgagggtcattctataattataaaggagtcaattatccaagtagtcataatcatcttaagctcctaacaacaagtgtcaaaattcatgacatgaaatagacagaactgaaaagagaaataggcaaatccacaattacagttggagacttcaatacccctctttcagtaattaatagatcaaacaggcagaaaatcagtaaggatacagatgacctgcacagcactattaattaacttgatctaattaacatttatagagtatttcatccaataacagcggaatgcacattcttctcaaacactcatggaatgttcaccaagacagaccacattcaggaccatcaaacacaccttcacaaattaaaaagaatagaaatcatacaaattacgttcttagatcacaaaggaattaaactagaaatcaaaaacagaaagctgactatagtaggaaattaaacagtacacctttaaataaaccatggttcaaaaaagaagtctcaagagaaattagaaaatattttgaactaaatgaaaataaaaattagaaaactttgtgttatttagctaatgtagtgcataaaaggaaatttatagcatccaatgtgtgttagaaaagaagaaattccagaatcagtagcctaaacttctaccttagtaaactaaataaagaatggaaagttaaaattgagacaataggagaaagaaaataataaaaattagagcagaaatcagtgatattaaaaacagaaaaacaatagagaaaagcaataaaagccaaaagctagttctttataaatattaataaaattgataagcccctagccacgctaaccaaggaaaagcaagtgagaagacacaaattactaacactgaggaaaaaagaggggtcattaccattgatcccacagaaactgaaacgatgatgagttgttactgtggacaaccctattcccataaatttgataatttagatcaaattagccaattccttgaaagacacaaactaccaaaacttacttaaggagaaccagagataacttagattgttctatgcctattaaaccaattcatttggtagttaaaatccatctataaaaggaaataacagaacaatacggtttcattgatgaaatctgccaaacatttaaggaagaagtaataccaattttatataatatcttccagaagacaaaagagaaaggaacacttcccaactcattttatgaggttagaattactctaatgccaaaatcagataaagacattaaaagaaaaaagagctacaaatatctctcataaacataactgtaaaaatccttaataaagtatcaacaaattggatccagcaatatttaagaaggataataatatatcacaattaaatgaggttcattccaggaagagaaggccagatcaatatttataaatcaatcaatgtgtaatacatcatattaatagactaagaaaagcatatgatcgcatcaatatatacacaaaaagcatttgacaaagtgcattgctcattcaagattttaaaactccaaaaatattaagaatataagggaaatttcttaacctaataaggatatatacaagaaaccaatatgtagcatcatatttaatgtaaatgaatgaatgttttcctaataaaattgagaaaaagataaggatgccctcccacatcatttctcttcaccatcatactggaagtcctaggtactgctaggaaatgaaataaatagtatacagtttgaaaaggaaggaacaaaactgtctttattcatgtatgatgtggctgtctacatagaaaatcccaaaagatctaccaaacaaacaaaagaaaaacttctggaacaaataagagaatttagcaaggtcataggacacaagattaatatacaaaagtcaattaccttcttatatgccagtaataaacaaatagaattgtaaatttaataaactaaataccttttgaaatagcatcccccaagatgaactactgagatataaatcaaacaaaatatatacagcatctgtatgcagagaactaaaaaacaaaaacaaaagaaatcaaagatctaaatcatggagagaatgaagagacaactatggaatggaagaacatcctgcatttataaaccatacatctcataaggggttaatattcaaaacgtataagaaactcaaacaactaaatagcctggccaacgtggcaaaaccccctctctatgaaaaatatccaaaaattagccaggcatggtggtacacgcttgtaattccagctactttgcaagctgactcacgagaatcatttgaagcctggaggtggaggttgaagtgagcagagatcgtgccactgcactccagcctgggcaacagagcgagactctgtctcaaaagaaaaaaaaaaaaaaaaaaaaaatttttttttttacatgggatggcaaagtacagaacagccaacaatattgtgaaaaacaaccaagttggaggactcacactgcccgattttaagacttactataaaactacagtaatcaaagacagtgtggtcaaaaatacagacacatagatcaatggaacagaatggaaggcccagaaagctatccacacaaatacagtcaactcatttttgacaaagatgctggaacagttagatgtttatagacaaagaaaaaaatccttaacataggccttacagcttacatgaaaattaatatgaagtcaaaatagatcatagacttaacatataacacaaaacaataaaactgctagaagaaagcataggagaaatctacttgactttggatgtgctgactagtttttagatacaataccaaaaacataattttaaaagattgatagttgaactttattaaactttagctctataaaaggcactgttggccaggtgtggtggtttaggcctgcaatcccagcactttgggaggctgagtcatgcgcataatcacttgaggtcaggagttcgagaccagcctggctaacatggtgaaaccccaactctactaaaaaaacacaaaaattagctgggcgtggtagcacgtgcctgtagacccagctacttaggaggatgaggcaggagaatcacttgcacccgggaggtggaggctgcagtgagctgagatcccaccattgccctccattggaggctgaggtggaaggattgcttgaattcaggtgttcaagaccagcctggacaacatagcaagaccccgcctctaaaaaaaaattagctgggcattgtagaatacctgtagtcccacctattcaggagactgtggtaggaggattgttggagcccaagagtttgaggctacagtgagctatgattatgccactgcattccaacctgggtgacagaacaagaccctgtcactaaaaagaaaaaaaaaaaaggatgaaaagataagacacaggatgggagtaaatatttgcaaatcacatagctaatgaaagattgtattagtcagggcttctcagagaatcagaacttttaattccaaaggccaggggcctgaggggagggtaccagctattataggacccagagtttgaagacctaagaaccaggagaactctgatgtcgaagaagaaaagaaggatgctcagctcaaggaaagagagagaatttgcactctctctgcctttctgatctattcagaccctcaatggattagataatgtccatctacattgctgagggcaaagttctttacctagtgtactgattcaaatgctaatctcatccggaaacaatctcacagacacaccaagaaatagttttaccagctatctgggcatcccttgtgatagcccagagaagttgacacataaaattaaccatcccaaagatcatatccagaatatgcaaacaatgtctaaaactcaacaataagaaagcaaacatctacattaaaaaatgggcacaagatatgaacagacatctcaccaaagaatgtatacaaatggcaaataagcatttgaagaaatgatcattcgtcattatagaaatgcaaattaaaacaactactacacacctataaaaatagctaaattacaaccaactggcaataccagtgctgatgaagatgcagagcaacagaaactgtcactcattgctagtgggaatgaaaaatggtactttggaagtacggtttggaagtttggcagtttcttataaagttaaacattgatttaccatacaatctagaaattatgtccctaggtatttactcaactgataaggaatcttatgtctacacaaaaacctgcacacaatgtttatagcagctttattcataataaagccagatgcaactaagatgtcctttaataggtgaatggataaacaaacagtggaacagtcatactatggaacattattcggagataaaaggaactgttaattcacacaacaatatggatgaatcttaagtgcatattgctaaatgaaagaagccagtttccaaatgttttatatatatatatatgtgtgtgtgtgtgtgtgtgtgtgtgcgtgtgtatatacatatatacatatacgtatatatatatatgataattccgtttatatgatttctttaaaaaagcaaatgatagagatgggaaatagatcagtggttgccagaggactgagaagaaggagacaggtggctaagtgaagcacagtggatattttacagccatgaaactattctgtgtggtactgtagtgattgatatatctgctaagggcttgatatctagaacatataaagaggtcctacactatccatttgtcactatgcatttgtcaaaaccatagaattttacagcacaaaaagtaaaccttggccgggcgcggtggctcacacctgtaatcccagcactttgggaggccgaggcaagtggatcacctgaggtcgggagttcgagagcagcctgaccaacatggagaaaccccatctctactaaaaatacaaaattagctgggtgtggtggtgcatgcctgcaatcccagctactcgggcggctgaggaggagaatcgcttgaacccgggaggcggaggttccggtgagccaagattgcgccattgcgcgaccttgcaacaagagggaaactacatctcaaaaaaaaaaaaaaaaaaagtaaaccttaatgtatgccaatttttaaaaatctactaggaggatggggaatcacaggataaaatgcagatgatggcaacagaatctaattgtattacaaacgtacgagggatctcattgaagggcatggagactagaggtgctgacctaaacaactttggaaatgactggaaacaagaagactcaagatgaaaagagctgtccataagcactgccctccagttggtagagctgtgtctcacaggggtatggtttgacaattctgaaaccccagtacatgtgtactaacattgaacaattaagtaaatggatggcagatggtaggagccaggtttttcactgctgaagtgggaggttatagataagcaaagggagaaggatagaatgaactgtatgaatgtgttagagtcagagacggtagcatgagctcatgtttaacttaatatagataccaatgatagatacagaatcattacagttatgtgaatacacgggctaggatacatacatgtatttcctagctctgccccctggtagtgggtccccaatagcaacatgcaaacccaccatccagatctgtttctaagaacattctccagtgaaaggaaccgggctccctggagaaacggctgattctagggctgggaagaaaatatgcaagatgagtctggagcagctttagtgccagaaagtaaggaagggctcaaaaacataacaaaaaattatggcaaagggaaacaggagccaatagagagagctcccaggcgccaaaactggaacaatttaagcaacaatataaataacatagtattggattataatgaaaagtacaaaataaatatccatgagtgcacacggatagaataaatgactgaataaaccagtagcagaagaattccaaataacttattacatactgccccctcaaggaagtgaagcataactccccatcccttaagtggaggctgtgcatagcggctattctgtgaggctattctcattattagactggggttattattagactggtttgggggaggaaaaccacagaggtacagtgtcattctcaaaaagttatatcaagagaatatgctatcaatatcaatatcacttaatgtcaaccctgatggcctagttaattatttgatcagtcttctgttgaaattattgttgttgttaattattattgttgttaattatttgatcagtcttctgttgatgagccttgaggcttgaggtaacgtctgtcaggtaatggcaaaggtaatgtttatatccaaaggtaatgttatcaccataatgctaactataacattataaatatatttttaaatggccacaatacctcagggcccttgcatcatactctgccgtgtgactttgctgctcctccctgggagaagtgatttctatttccccacctcttgaatctgggctggcttgtgacatgtttgcaccaacagaatgtaatggatgtaaattcacaccagttatacagtctcaggaggcactgcatgttatcagatgttgacggacacatagcctgaacacccctctaaccctagctgatagccagtcaactaccagacatgtgatttagaccatcctaaataaaccagccccagctgacccaccctttctgatcccagacacaaggagcaaatgcaaagttagctgagcttggcccagatcagcagtgctacccagctgacccacatgagcaataccaaaagctttctatttaaagccactgaatttcggagtggtttgttataccgcaatagctatgtgcctcactggcacctaggcataacaatgcatgtaggtgcttatttgttgtaacacactgtgattacagaagattagaagcagcctcaaggctcatcaatagaacactgatcaaataattacaggagagccaaacaatggaatattatgcagctgttcaaaagaacgaggcagccctatgtgaatcaacatggaacaaactccatgatgcatttttaagcgaagcagcaagaggcagaagagtatacagagcaagctactattgatcctgtaaaatacttgcatttgcatggactgtctccgggtgggtacacagaaacatgtaacaatggctgtctctaggaaggggaactgggtgcctggggaacaagagtggaagcgagacttccttttcacgctatcctcttttttatcttttgaatcgtgtaaatgtgttatccattcaaaaataaataaaaccagaatgtaaaaactcctatgcctttcaaatgcagagagccttattattctctttccaagactcccaagatccaccgggaccaaaaaacagcagtcagggaacaattccgattttccctcctctctcccccacagcccccacccgcgcagagcgaagctggcttctccggtaaacccctgcttgtgagttgcgcccaggcgacactacctcgcctgccaccggagggcagcgcgaggcttccttcccggggaggaactgcggcgagacggtggtcggccctgaatagcaagctggctcctagatcaaaggctctggcattccgtttttgcgtgcatgtttgtttgttttctttctttcttcttcctcttctttatttttttaaaggtctcgacccaagaaccccattccaggcagtaggttcgccagccattgcttgtgcgtcttcgcggagagagaggggggagatgccccggcgctccttacccggctggataagaccctttggggaacttgctgcttcgcaagtcttacttgtgaggacccggagggtttgcctttgaccccgcctgtgaccttaagaaaacccctttctaccctgcgcctgtcccacagctggaagtgataattttaagaatgaattaagcactcggtgtgtgacactgcggcactaagcactttctggactgtgttaggccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaagggctgctgggaaaaaggcggatttcaaaggagaagcagctaaggaaaagctctggaaagggccaacggagcggatattcccggagcccctctgcgagccacgcgcccctctgggaagcccgcttccccctgcagacaggcgctgtgacacgcttgcgccccggtcgaacaggcgaagaggccgaggcccagagcggcgcagggcgagcctggaggctgcgccccagacctggaccagccacggacgccgctcccgccgctccctccgctccgctgcgctccgcacgctggcgccggctccccgaggccccgggcgccccggccgcacgcctgggtaaaaggtcccgaggagtccgcagaagcgcgcccacgcccgagacggccgtttccgccggcctgggaaaggggcggagaagggggtcgcccgggccgcagcgtgccggtccccgccggccgagccgtgtttggggccagtccccgcaccccgcttcttccccacctggggagcggggcgccgcggtaggggcactggagcgcacgatgcaccccgccaacgagtcctttctgcagacggggttcctgttttcatgcaaatgcctttgttagcgcaccgggaaccagggggacggaactgcagctgacgcgggctgcgcgccgcttttccgccttcgcttgattcggcctcaacgacttaaacgcgccgggaacaaaaacgccggcgccgcggaaaccctcaggagcggcacgagaagcgcggctccgctggggtccgcgagaagcggtgcgggcggccgggctggtgcctgcaggccctctcaccgcatcaccaagggcaaggaacctccaactgtccctcagtttctctacctgcactgggatgtcctacataaggagtcagctcagtgcccgcatcttgctgtaattattttgtccaagcactgtgggaggcagcgttgaggaggctgttgtggggagtttgcctgtcagagagaagagggaaataaacaagaaacatacagacaaaataatttcaaatagcaacaagtgttaatatcgtagcaaacaccaatgcagcgcttatgccaggctctgctctatgctatatgcacattaggtcatgtaatcctcactcccttgtacagataggaaaatgctggttgaataatctattgaagggaaataggaagttgaacaatatgtggagaaacaggttgcacgataggtggagaaacaacaggttgcacgatatgtggggaaccaggttgaacaatagcctcaagtgcgcagtaggtaggctcggcacttgagaatattgggcccagcctgggtttcgacccagccagtccagccccaagtggaagcttttgcacactccattacaccagttttggctgtactaggaaggatgtaaagtggtgacacgcccaagagagagctggggctagacaggagctgctcctaaaaggatgtcaatggacgtctctgtgcaagagagtaagctgaggcctgcacagtgagaggaactagccatgcaaagagctgggcgtgtccagcagagaaaacagcaagggcaaaggccttgaggtgggagagtagatgtggggtttcatgaacataaggatggaactcagtgagcagtagtaaggagactggagatggtcagcagctgggggtagcaggctttgcaggtctcggcaaggagctggacttttattctaggtgtgatgggaagttgtgttgttatggccactgaaggagttgcgtggatggagttggaccagagggtgggtgcccttcctgccttgccagccttaggttcaaggaggaagttgattgcttaggccttaagcttgcccctcctcatctgacctcctggcttctaggacattcctgaggacgtacaccaagtctccaacattacctgatgtcagatcaggtaagccctcatcttatagatagggctaagactgaggccctgacttcagggatgtgtcttcacctttgagtaggagaagcaggggtggtatctgcttcatctactcatgtacctgcagcacctagcacaggctgaccagcccatccttggacccaggcaagcggggctctgccctggccagcctccagctgcgtacatccccacaggctagagagtctgcagtgccaaggggatatacccatccaagtctttgctccttgtctagaatactacagattcctaggattcctgagctccctacctaaaagtcccaagcctgctgccaggcctcttcctggtctattgtctggaggcagaacactaagcccagggtgtagccaaggggcactgcagaggatagggtgtggatggagattggacctgcagcctgggatgtctacacacatgcaggtgaggtgtgcacggtacaggatggagctggggatgagaagggaaggtggcagtttataggctgggaaatgagcgaccagggaatggggctggctctccccagcaccgccacatttcagtgcgagtatctaagaaatccaaatcaatcctggcctttcaggctgctgagaagttatacttactgaggagaaggatagaacatttaagagaaggtattggtctgatttataatttttaaatatttagatttaagggtgagtggacaccagcctccaccaatatcaagagtgtgtttggcctagaccctaggagatattcaatatttatcaaatagatggatgaatctcatttaatttaatcctcacacagactcaacggagggaaatcacatcgtctgtgctttattgatgagggaactaaggcttggagagatttaatgactggcctatttgtcaagttagaagtttgtctagcagagctgagagcctcaagccctaacgtgtctgattccaaaatccattgcaattggttcatgacaagttcactcccattatgaccacattaaatatattataactgtttgagcatgtcactcgctgatctttgggaacataagcactgtttatattacatgaaaaaggccttctcttcttcattcttactctaccctctcaggcacctttgggaagtagtaagacaggagctaatgctccatttaacaaatggaaaactgaggactgagcaatagcccaaggtgtcaacgaggcttaaacaaatagggattttttttttttttttcatgtagcaagaaatccggaggtagctgggcaagggctggtataatttttgcattattttcagcaaacaacttctgcctcttggtctcttctggctatttattgctacagcataacaaactgcccccaaacaacaaccattgtatcgtctacagttttgtgagtcagaaatttgcgcagggctcagctgggtgatccttcagtgatccatggagcgccgactagagtcactcagtgatcttcagctgctgattgtgctatgctggaggatcgagatggtttcactcaggttcctggtgctttcgtggggatggctggaacactgagctcagctgggtccgtctgcctctccatggaatcccagggcttctccaggtgggtgtctccagcagagtagtttgacctttttcatggcagctcatggctcccagaggccatagcagaaactgccagtcctcctagaggttaggcctggagtgggcgtgacatcatttccaccatactctattggtcaaagaagtcacaggtcagcccagatttaagtacaggggaaattgactcctctcaaagggaggaggatcaaagaatccacagccatctttaaattatcacatggtccgagctgcttgagatgtagtcatcatgtctcaaattccagaaagtgtggaggactggtggaggaaggtgtttaccttcccttttaagacattttctggaagtcacacacaacattttccattggccagaacttacatgggcatacctaggatatggaagggaaactggaaactgtaatctttattgcaggaggcaagccatgtattctgatgaaaattagggattttgttgactaaggaagaaggggagcatgggtattgaggaccaactaaaatctattccatggttaggtgttttgttgttgttgttgttgtttttgctaccaacagccaaacactgttcctagcagagatgtttctataccagtcttctccttcctaacacatcttccactctgtcatcaaaataatctttccttttttattatttgttatgttcctataccgtatatcttttaatcattcctatgccaacagcaagtgtccgaattattttgtgttgtgtgaaacagtaatggggtttgccacacaccaggcactgtgccaagcactaaatgaacatatctcacttgatctccgcagtatcccactgagtgaggatcacagacgaggaagcagaaacccagagaggttaaatgacttgctccgggccacacagagagtaggtgcaaggctgagattcaaaccctcgactgtcagattccagagctgtgctgtgaaacccacacatgtgaagctcagggactgtttatggatgacagccccggagcatgggcaagacttgtgcctggtgtgtgaaggttacaggtgacaaatgtgagccaagagcctgcagatgctcccttcccgctgtgatccttcagtagggaagactgcatcaagccccagggccatgctggcatatttcatgaaattaaactggcaccaggaattcatatcattctatttcctttacaccctgactgaaccccaagtctggaggagactttgcagaactggctacattgctaagcagggcacaggcccagttaaatgaggcacctttctgctccagctccaagcttctctgttctgaccccggtctttcttgcctttgcctcacccctgttcgaggacatgcagtgactccctgttcccctcaagttcagttttgcctttctccaaatgctccttgtaaggactggggagaatacggttccatcctttcggtgaatttcagtttctgcatctgtcaaatgggaggaaataatccctgctttgctaagtaattgaaatgttgaggaccacacaggacaaggaataggaatggcctttgcagggcagagcaggcgaggggcacaatcccactggatctgagtagtatttagaagactaggcattatctcctcggaaggcagaaagatctggggtagggagtggggttgtggaggatcagggagtgccctgcaccttcttgtgggggctcctgcccacagtcttgcagaggaagtggcccagggtgagcatttacatattctatatgccccgctggggggacacagtgagaccaccggttctgaaaccagataaacctgtgtttgagtgtcccagcttcatctcgtactagctgaaggacctttggataagtcatatcacttctgcctccagtttcacagctataagttggggctgaaaaaagaacctgtctcattgggattttataaggaatcaaatgagaatgtgcgcctttaaagcacctcatttagcacagaagaactgttcaaccaatagtcatggtaagagtgactggtgttttttgagccctgattaaattatatgccataagagtcttcttgattagtttatatactcctcaccacaatgctaagatgtagttaacattattatttcccacttgtagatgtagagatggggatgcagttaggctgaacgagctgcccaaggtcatagtaagtggtagaagctgggcttgaaccggaacccagtctgtctgatgcagtcttccttaatcaatagccatgctgttactattactgttgacattactattattgaccttgaattctttacccaatatctccacacttccacaacacctggtgggggcaggaagagccacctgacccaaagactgccaaaatataggctgagcagcctgtgatacagcctgggacagaagctccacccagcagggctgagcccaattaactaaactcatcagcagtgatggtggctgccagtttgaattggaccacaaagagttgggatgatgcctacaagctgaaagaccctaaaagatgacataattcaaacaaatgtgaaggcacaggggcaatgagtaagccaaacttccaagacagacaagggggaggagaaatttgacaaacgtctgctcctgagatgactatgaactgactcagtcccagagcactgggtcctgaatgatgttccagtggctaagttgtattctgtgatgtgtggtcaaaattcctgccttccagtccctgcatgtagctttacaacaacccccatggctcaagttaggagagaggctctgctcttttcaaccaaaattaggctagctcagctctcccgtttatctttagggtaaatgctaagatttggaagtggtgaatggagagggaggtaggatcaggacatccctccatcaatcccaggtgacgaggcccagaagacatggcctggcccagttcctgttatatcagaaccttagtccatgtctcaccatctacaatcatatcctaagtgatctcactcaccatctggggtgactccgggccaggcgtctcccctgcactccagcctcatgcccagctactaactccacagctccgtccgtgttacacaggcatgtcaaatctcacctgtccaaaatggaactcctgattgtgcctccaaaacccaccccttctgcaggattttcatatcaggaaatgccaactctataattcgagctgcttaggtcaaataccttggagtcagccctggctgtcctgagtcatattccaacattcttgcagtccacaaattctattggctcttccttctaaacgtatccgtgccctccatgatcaccctagtctgacccactatcgtctgtcacctggggtgacacaacagcctcctcttgcctctggcctgccttctacaacttgttctgaactcagcagccagagatgtcctgttaaaacctaggctggagcttgtagtcctcttgctcaaaacccacccatcactgcccttctcactcagaggaaaaacaaaggcctcctaagtcacacagtctgacctcctcagtttcccctacagacctgcctccctgacctcacctcccagagctctccccagcccttcctctattccagccactcaaggtgatcaccactcctggaaggagaactcccacccatgggcctttgcatctgctgtgccctctgcctggggtgcccctccagcacggctccctatctcacttgtgtgggtctgcagagatgccttccctgggtacctcattaaaaattaccacccactccagcagtccctcccccgtctccttccctgctttaactttctctgtagcatttaacaccatctattgacacgcggtagattttacttactgtttcgtgtcatctcccacactgggatgttagctacgtctagggaaggaccttcttccatcaggtgtatcccccttgcctagaacacagcgtctgatgcatagtaggtgctcagcaaatccttgtcaaatgaacaaagaagcacacataagaggacttcctggaggcacccctacccagttctcacgcccccagcagccaccctctgggtgttccaggccctaggctagtcccctcacttctttgatcctattcaggggaaatcggcctcaggccctgtccgaaaacaggagaactaaggagaagctagtcatggaggaattagtccaaataggtggggatttctttttaattagaactatttttttttttcccttcacacaaaaggacttgtgtcccagtagctggctctcctgtcaaagcttgtcccgggctgagagctggagctctgtgttcccaccaaggatctactgtcagaatcactggagagcagcgtgggctttacagaaggaaggttctggggcagcaggggcacgtggcctccctgggacaggcacacacctggaaaccccacaaatgggaaggactccatgtgggtgacaggtgaggctggtaacaagcgtgtagggtcactgtactgttctctccacttcctgtagtttgagaattttctttagagagagaaaaaaaaaaaagagtgtttttcccctgaagttctcttttcccgacacatgcccagaggatttcctgtagccctccctccccaccataccccacccacaacttctcttttctcctcccctctgattcgaggagagagccattctgctctgcttactagctgcctgtctgcatctggggacacttacaaacctttgatgcctgtttactcccctactcgccaagatttgggtccagatggcctggtgaggtggtgctgggcactgatggttgctaaatgctccctgggtgatcctggcactttctagagttgagcaactaccttgttaccccagacccagccctgactctgccacactcagggatctcctgttaatagggtccagcctccttagaagacagtttaacaacatattttgttacctgagcccatctttggggtccaccatagctgcctaagtgacttgaggagatatttcttccaaacccagacaaagagcctcattcaccaccagcactcctggtggatgacatcctccctgttaccttatgcgacacgggttccctgtgaccatttggaaagtgcagagaagcacacaggagctggccacagcccacttcaagcccaggaatttgtgaacagaaaggagccattgtctccagtcacttgaagggaacagctcaaaaacacattcaaagggccctgatgataatgaatatgctaatatgatttccactgggcgcctgtgctacctccaaaaaaccctttctgaccttcctcatggattcaaagctttcattgaagtcgacaggggattttggttaaaataacatgaaagttttcatttaaatggacaaagctgggagttgtgaattaagcatgagtttcacattggtcctgacacccctgaccttgatggggaaatgcatagattgtgactggaccttctggaccttctagctattgcctttgggtgggcagagctagcaagcattaagggtcccttttgcatgacaagtgaactctggagacctaggtttaaatcccagctctgacacttactagctgggtgaccttgagaaaggcaaatcatttctctgattgagcctcaatttccccatctgtaaaatggtttggataatacttcccttgcagcattgcttccaagagtgaataagaagtctgtatgtgggaggggttggggaagtggaaaacatcttggagctccccaccgtctcacccagtcagagacccagcaagggtgtgaacacctccagcctcccatatcccagaccttctttccttcattcagcgtatatttataaagcatttcctgggtgccaggtactgttttggggctggggattcagctgtgaacagaacagatgaactctgccctcagtggagctgccattgtagtgggaaggacagacattaaacacatgaatagataaataataagtaagtgggctgggcgtggtggctcacgcctgtaatcctgacacttcgggaggccgaggggtgggggggggggtgttggatcacctgaggtcaggagttcgagaccagcctaaccaacatggtgaaaccccatctctactaaaaatacaagggcgtggtggcacatgcctgtaatcccagctactcgggaggctgaggcatgataatcacttgaacctgggaggcggaggttgcagtgagccgagatcatgccactgcactccagcctgggcaacagagcaagacttcgtctcaaaaataataataataatatgtaagtggtaataagttctttggagaagaaaaacaaagtccttaatgaaaagagcagagctttagaattagacagagctgaattcaaatctcagcttgctctttgctggctgtgtaatgcctgggaaagagattttatctccctaacactcttctgcacattttttaatgagacccactgatgaatcacccacccattgaacaaatatttatagaactctgggccaggcacggtggctcatgcctgtaatcccagcacttcaggaggccgatgcaggcgggtcactgaggtcaggagttggataccagcccggccaatatgatgaaatcacatctctactaaaaatacccccccaaaaaagaaaaaaaaatagctggacatggtggcgtgcacttgtaatcccagctattccagaggctgtgacaggagaatcgcttgaacccaggagacagaggttatagtgagccaagatcgtgccactgcacttcagcctgggcaagtgagccagactccatctcaaaaaagaaaaaagaactctgtcctgtgtcaagcattgttttgagtgctggggaggccacagtgaatgaaacaaaaatccttgcccttgggagcttaaaatctaaaagggagaaatagacaattaacaaatatacgtatatcaggtgatgaaagaaaaagcaagggaaggaggtcaagaatgtggaggacattatttcagggagtggtggtcagggaaggcctctctggggagctgacatttaagtggagctttgaaagatgtaggggagttagccatgtgggtgtctgaaggaagaaccttcccagtcggaggagacatcaagggcaaaggccctgaggtagggccatgcgtggctgttgggaggattagggaattggaggcaatgtctaagacacacccagcacagcccctggctctgagtgggggttcaatcaatagcagttattatttgtactcattttatgaaaaatgcaagagaagtcattttccattattataaaagttcttgaaggctttgtggattgatgactttattcccttttcttcttttgtttttctgaatcagaaccagcaagtccaacccccaagcccacctgccagcccgcctctgtgcccccagtcccaatccggcaggaatgtttgacatgcagtggtgctggagggagggagtgtgtaattaatgatggttattaaataataatgccagcatcttgaagttctttcctctccacagcctcacaaattagacgccttcgaaatgttgtgcccgtcgccaagatgcacctccatctggggtggaagcaacatctgctaaacagctgcatcttgtttaagagctggtacttaattcaattattcagctctgataggggcaggcagagctgagcggaaggggcaggcccagtcatgggcatatgctgctccacgtcttcccaagttgacccaaactcctctcccacagcgtccccactcgcatctgttgattcaaccaacctagacatctgtacatttccagaaccggccatgctcactcatgctgcctccttgctttttactcaagctgtgtgcccctgccaggaacactcttctgctgcctgtccaactcccgtgtccttcgaaaggcccaactcaaacatcagtatctcctccaggacagagcatagggaattacctcccatgagctctctcggtgcttcatgcattccttaactggagcattcataacattacattgcaattttgtgtaccctgctgttttgtaagccccttaggctgggaaccatgtgtatttcattcttgttatctcagcattgtacctgactccccatagacacacccagcacagcccctggctctgagtgtttagttaatggatggatggatgggtgggtgggtggatggatggatggatggatgggtgggtgggtggatgggagggtggatggatggatggatggatggatggatggatggatggatgcatgcatggatggatgggtgggtggatgaatgggtggatgggttggtgggtggatggatgggtgggtggatggatgggtgggtggatggatgggtggatggatgaatggatggatgaagagatagaagaatggaagaaaggagggaagaacaaagcggtagacaaacagatggacccactgccaccatctaaatccaaacaaccatcatttctcactgaaacactggggtctctcactggtctttcagtttctactcttgcccccagtagtctcttctactcaaagcacttagtaatcttttgaatatggatttatatcatgtcactcccctgttaaaaaccttccagtggcttccatattcctaaccctgacctccaaacccctataggaaacagcccctgcttatccctctgatatcatctcctctctgtcctatgctctgaatacttggggaacctgccaagctctctctcacctcaggacctttgaatctgctcttcccctttgcctgggactcacttccctggatttctgtcaagctagtatcttcttaagtcttccagtctagctctaatgccacatcctcaaagagacacttctttactttgccagttaaaatagccaccattgtggtccttaaaggccaaggggcctgatccaaataccaatgctttggctgctgaaacccaacaggcttcccagagcatcatcctcagctggggtcgtgacgcagacctcccccaagtgcctgccctacaagccatcccttccctgggtgctcactcctcctctccatcaactaaagatccttcatgaatgggcttgtctggaactgccgcaattaaactatcagagcaacattggaccatttgtttactatggcacttagagctggaatggcttgttgttttgactgtttctattttcagctccatttcctaggggtagtggggagagggtaggcaatgaatcctggtctgttcaagcaaaaagatgcatcagtgaagcctagaatttcagagtcacagaattctagcatcattgtcatggaatatgagagcagtgaaaatctataattttggttataggttcctagattcacgagattctagaatcttactcaatgaaattagaatcttaaagtcagacaaatttagactcaaagtcctagagtgatgggctctgaggagactgtcactttgtctactccatatctctttcccagaagatcttctctgggtaccttatccacaacgttcccccctaccgacccacagcctgtcactctctattgttttaatttttctttatggctctgatcaccacctgacatttgatctgtttctctgttcatttgcttattgcctgtctccctcacatgtgagattgaggtcaggaactttgttttgttcaacgtttagaacaatgcctggcatgttctaaacagtactcagaacaatgcctggcatgaagtaagggctaaaaaaagcagtgcccattcatccaaaaaatatttattgcatccccacttcatattggtgcctcagagatgatcttctctcaggacaggaagcaggtctcactttgcatgccaaatgcaattggcagtagatacccagagcacggtgttgaaaagacttcttggggcttatccaagctccgtggggaagggcaattgatgagcaatgtctggcatagactcagccatgggaaaaagtggccatctctgctctggcctccaaccctgcactgaaaaaaactgaggtccagaagaagatgcactgggcatgcatggggtgcatagccagagttagaaccccatcttcagtctcccctcagtgttggttcctgagcccaagcctctcacaagcacctgtgtgtgccctcccctccccatcagcccttaggctctccctcccccgaggccttcctgggatgaaggggctgctggagtccctggccctgaaccacagcctgggaacccaattctggaacaccgcctgaatgcgcaagccagttatttttaaaaatccaaaaagaaaaggaagaaagagaaagctcactgcttcggtctccgcactagccctggctcagagaatagagacttgaaaggaacaaagggtttcctcaaacacagcagatcaaggccttggcttatgtggtaaccggtaaccgaccaccgcgctttgtgacaaatccttcagaaggcaacggcctctgttccctctgcagccttggcagaaggaggtgggggagcaggggacacccttccccatcgccccccagccccagtcgggctgcttacaatcatggacttcgagaacccctgactgttaggacctcaaaggccttcacagagcatggaatccaacccgctctgggtcagccaggcaggcagaagccctggacaggctcaaggtcacactttcctcctccctgggttctctttgaaggaggtggagaccagggaagtgcacccaagcctccatttcctcttgaacccatcacagctgcctgagatgccctctcagaactctcccagctaccaagattcctacttctttttttcctcctgtggatttcttcttccaaggtgcctgtggggtgtggtttgacccctggagacctgggggtctccaggtacacagcaggagtacacagaggggtacacaggaggggtctgctggtggattatgagatcacagaaggactacagtccaccctacactccaggttggacaatagcagctgactcaggtgctgtgccaagccctttgcagtgaggcctcctgtaggcaccgtggcgatcctatgatgtagataggcattgttagccccattttccagacaagaaagccaaggctccaaaagactgagtaagggccccaagggggttggcagggattggcagagctgatgcttgaactcggggttgcctgtcttctaaaccacactctgttaactggtctgctctgccccaccctctgtgcatcaaaggcaggcaatgcttcaccccactctcaggcactgaggaaggcagcagaggggccgggctgggaacaaggggcttccctccattggaggccattgtgctcacaagccacacactcgcacctgcacgcaggctgcagagcccatcaggtctcctcatccacccctccatgtcagcctctctcccctgcctccttcctgacttgcaatttctctggctcttttctaccccatctgtcaatctgcatcgtctccattctgtgggcctctctctctttatcattttctgcctctagctctgtctcttccccagccctccccatttctctattcctatgtcttccctttttgtctctctgcatctgtgtgctactttctctctcctcagcatgcttgttctgtctctctctctccctctctctctctctctctctctctgtctctgtctctccctcccacctctccccccacaatattctgtctctcctttaatcctcaatatccagggtttcagtgtctccatgtctcttcccccagcccatctctccctctctattcttacacatctctccctttctccctagcattatctccctctccctctgtctctgctctatcctcccttgctttccctcctgcctctctttctgggtgtgtgtgggtgtgtatgtgccttgtctctctctctccctctttctctctctctctctctctttctccctgcctctctccatccctctgtcactctatctccctccctttgtccttgtctctgtctctttctgcttctctgtctctttctgtcttcctctctgtttttctctctctttctgtccctctgtctctttctctgtctcttcgtatctctctgcatatctctcgtttctgtctctctgtcgctgttgctgtctctgtctccccttcatccgtgtccctgcttctccccttctctctctgcctgtctctctagccttcctcaccttccccttgccacccttcctggagtggctcctctgtcgcacccccacactgacacacaatattccagcaaatcccggcttagctgtaggggggaacaaggagggattggtcaggggtattccaaaaagtggatttcagaagtgaggtgggattgttatgttaaaggaaacggcgccagccttgtccttttcttcctcagaaatgactggttgctttcctgggaggcagaagaaaaaaagtccctgaatagagatttaaagcagtaagctcagattccttctttttaatatttataaagagagaaaggggataatttcaggaagatcatttcaaggcgaaaacccacatattttcaatagaattattccaaaagcccctttccggctcattggagtgtataattttgtaagttaaagacaccaggcctggtttccaagttccctaaaatgacgcagctaagtaagagccagaaggaagtaagatgaggagaagagggggagggcagcagaggagatggacaagcttgtcccagggctgaggccaaagagagcagcagccggcatacctgccccacctcctctccttcgcctgtctcctcaacaagccagccaaactcagggctataaacgttgtcaaatacctgtccccaatcccgagacccatctccaagtccagacttatagaggcaagtgccggtgcaggtggcccatgggctcttcaggcaagatgtgttcagagctgcccccacccccgccatcttcctccccacaccacctccatccttggcccctattcaaccaccgctttgcccaagctggcatctgggagtcaggcttgggtcctccctcacccctgccccttctagttagttgccaagtcttgttgattctacccccttcatacctgtgggatctccttacatgtgcattttcactgcccagagtgggcctccgcacccctgacctagaccacagagaggctccagcaggtctctgggcctcttgcctatattcaagctgacggagtgaccttcgcatagtccagctctgaggatggccttctctttctcagaaacagtcagagccccctgtccccgtcacctctaaggtgaaggccaatttcccccaccctggcatccatgatctagctacagcctgatttccttgtacccaccctcccatcacaagttctccactgtggccaaaatgactcactctcttctgcctacccgaacggaataagaatcatttttcgacttctaagccctggctgtggctcctctcttctcctggaatggcatcctgctgtcttggcctgtgttgctcccacccaaccttaagttccagctcaaatggtcctcgtggtcctcctggtcacgggttatctttccttctctttgacccatgacatttcactttagacatgagataggctgtgtggcctgagaacaggtgaggtccgtggctaaataaggaacaggaagtggagaccactctctgacattctcccaaaccaaaccaagtgagattctgtggttctgctgggtgcctaaaattgtcaccagggtccccagataatacttactcttatcacagtaaatagcaatgtcattgcaaaaatcagttattgagtactcactgtgagccaggtaccttgctaagtgctcttcatgtgttatctcacacagttcacaataaccagtgtggtgaggactatcatcgccccagtggtactgatgaggaaactgaggctcagagagggggagtggccagcacagcatcactctgtgagccagaaagctcaggactctggccaggccagcccaactctggaatccttgagtttaacctcaaacgcactgaaaatgctgacacttgagtattagcaggaactgggtgatgcagtccctgactcacctcccataaaggaggaccatgtgctgtgaggccatggccacagcccttccttgggcccagcttccccatcttctcaatggtccagttcctgtttgaaaaacctttcagaggctggttctgtaaaccctggagacacagtttgtcttcctttccctggggaaaggctcatctgggagaggtagagcttagaacttcaaaggaagccacaggggcaaaaatatccctcctgcctcttgtcccaacaccattcttggtttgacttggccaagaatgttccctggtccacctctgaaagtctgcagggatgcttccagctgttcccactaaactctgcttcctctgacccctgccaagaactgacccttaattcccagactgtagcttcatctctcaccggggcatctacaccagcctcttcactgctcccactctagaccttacctgcaatgcagccttgtcgttttaagcaaaaatcacaaggtctctttagttcttaaagccctccatgggttctccccacagaatacagctcgagctgctcatcccagcccccaggccctgtgtgctctgatccccaggcctccctgggctctggccacaccatccttccaacagggcctagaacaaaccaggttcttcttcacctcaaggcctttgctattatgctttcctgaattgctttcctggctttttccttcctctctttcagttcaaaaatcataccttccccaaggccttttctgatcccaattatccctggtaccttcctccctgcagacattcacaccagcgatgtgttcatttccctgtaatgtgcagttagatatttgaatgcttctaatgtaccgtcggttggaggagtggcagctgcaaaattgcagactaggaagctccaagctgtcattcaccccatggaagcaccaagaaaacaaccagagactggtttagaactaatataggagctctggaaaacagtcaaaggtttacagcacccaggtgaatacctaatcaagaaaaagccaccttcaaacagcagaaaaagttttgtggcatttttactcccttttgcccaaccccctccctggcacagcagcccatttccctcccttgagccagagggagcaagcctaccttactggcaacactctaactggtctgaggcctgcctggaggacagctctctgttttgtctaactaaaatctcaggtagagggaagctgagggcactgttggtggaagctgcagggagactatagacccatagatgactggggcaagagattatgagtggacacacacaatagaccatctgtggccctaaggagaagctgggtgctggggtaagattctttgaaaaagtaagacattcaaaagcagctgtacatatggaggaattgagtaagccacatttaggagcaggcaagattcattctcagaaaagacctgagaagacctgaagctttcaccttggtgaaggattgtgtaacacagagtcagtttgcaaagcctgggagaggcagctgttttttcaaatgtccagttttcaacaacaacaacaacaaaaacacaacaaagaagtagaaaacatggctcattcaaaggaataaaataaattgacaggaactatccctaaggaagcccagacattggacttactagataaagactttgaaacaactgtcttaaaaatgctcaaagagctaaagaaaaccacagaaaaataactaaaggaaatcagaagaatgatatatgaaccaaattataatatcaacaaagagatagaaattataaaagggaaccaaatataaattatggaactgaaaaatacaataactgaaatgaaaaattcactagaagagttcaacagcacatttgagagaaaacaaataacaaaattgcaaaagttcctaattaccagtaattagtttaaatgtaaatggattaaactcaccaatcaaaaggcataaattgacaggatgaatttttttaaatatccaactatatgctgtctacaaaagactcattttagatacaaatagattgaatgtgaaaacatgaaaaaatatatttcatacaaatagtaaccaaacgagatctgagatggctatacgaatgctatacataatagtcaaatatgtttacaagagacaaaaaacattatatactgataaaagtgtcaattcatcaagcagatataacaattacatacatatatgcaccaaatagcagagttctaatgtattattcaccctgctccccagacgttattccatgagagcaagaactggatctggcttgcttactgctttgttctcataccaggcatttatgactaacacacatttgctcaatttccactatccccactaggtgaccacagcaaaagtggacagatagcgtctggcaagcttcaggcaggagcttgaacctgaccatcttcagctgtcccagctgtcacctccagaaatctgagatcctttccttgccatccatggtccaaccatgaaaataggagtgaaggtgtttaggaattgtgatcaactctagtctccccagccaagcacttcagggcttacggctgcatatcagggaatccaggggaccaagggaggcgggtgagttcaccattggagttgtccagtctgaatggccagtgttacccatgaggaccctgaggctcagagagggcagggaaccagctggaagtcacacaacaagctagtggcagagctgctgactgcctaccacctgctgtttctctaagttgccttggcgactgcctcagggactgcccatagcatgcaatctctctaagttatcccttcccctccatttcccctttcatttctccttttcttcgtgttattttttgttctccatccctataccacaccaggcctctcacggcctttcctagatttctgagttagaccatctcatttgacccccacaatgacctgtgaaagaagtgccttttaaagccccattttccagattagataactgaaaccctgagatagaaagaggtcagccagtgacgccatgtgggcctagaactctgcccagcctctttactccaggttccaaggccttgtctgccctcaaaagtatcaagagatttatttaagcaaaaaacatcatgctcactacaagcttcttaagaaagccttcttccaatcaccaagacccctggctgtctttctcctgtggattttccctttcatctcaggatgaccgcgagatatgaatgttaccctccaagctgtagcatgcaggaaggctggggcccagacctcaagctgaaggcattagggtgggtgtagggtgtgcccagttctagacaatttcaacctcaacaagctcagtgcatttgccacttgataagtgctgagctgaatggtttgcaggtgttacctcaaattcatgcccatcatgcttaataaggtcaaaacccttacttcattttgcaatggaggacacagtttcagaaggggaagtgggttgcacaagagcactgatggtcattagctggtctgctgggccttgctcttaaccccctccttgtcttggatcagggaccacagggtctgtgggtggtggtgcatgcaaaacatgaagatgtacagaaggatcagagcttgtgtaaatgtgtggatttttccaggttgccttgccatcacttgttttttcttctagagagtgaggggcagggagagttcaggtgggaaggcccgggatatttttgctgaaaccatctgttctaggcctacttctgaaatgccctgatccacataggggagggggaaaacagagatggtcgagagtccagccaacgtctaggggcaaagatgaggggctcagaactcagcaattcggcccatcagtcagggatagcagcctaaaactgtggtcagccatggggtctggagaagactgggtgggatggatggggaaatgtttctagaaggaagaaggagactctggttcacccccagtttgcaggatggagtcattgtgcctttagggaagagtgagcagctggctggaggtctatactcctgcctgcttggtctggagtttctctcaccctggtcacttgatcctcttacttttcctgtcagtgaggaagctgtttactcccagaaagtcattcattccctgataagatcaatctcattgttaagcagaattttcacttcctgcccgggagttggcgtagcgcgaatgtccagcattcagagccccataaacagtcagcatgagagaggccctagaggccaacactgcccaacagctcctgatgtaaaaatggggaaactgaggtccagagagaggaagagcagggaaaggagtcagtgtcagagctgagcccaaatccaggccctgccaccgctactccaccattcctaggtcaggtggtgttttgcatgccatcaaagaaccccacaatttcatgcgctcccttttgattttaagattcaacatgccattctaagaaaacttgctaagaaaacatttcaacacaatataatattttaatgtaacactaatatactattataacattgcattcaaatataatgttctaacacagattaatattctaattcaacatttcagcacaattctaaccaatattctaatcctacactctggagcaacataccattctaacacataacattacatcatgtcctaatgcaatattataagacattgtaccacaacattccaatctaggctgctaacgcaatatgacatttctgtattatttgaatgcaattctaatacgacactctaaaataactaagttattactctaatattaagaattctgagattttaagcctctggaatgtccactggacaaggtgatgtcatgccagtttgtgattcatgacgccagagcccttcctagttccagcggcccccaggacccaggtcaggtaggtccagctgtctagctttgtagagggagggcaggtccttcccaaggcacagggcagggactccttgacctctggtagctacctgtctcctccaagccacatgcttttgtgggctctgggttggggtaagggagaaggaggaagaggccacccattctgggctcactttgagcctgctgggacaggcaagaatgatcccaatattcagaccaggcacttcttgccagtttctatgtgggttactaggactaagaataagaggaagatagtcaggttcctgaggcagcactgactccttcaggcctgggggaaccacaggacacctctcaacattgcctccttctgttctctccctccccacccatctgcagccttccagccacaccggccgccttgctgttcatcacattcaccatttcccatccctgggccttcacgcttgctgtttccctgtgactggactgctttcccccaggtttccagtgatccatctcctcactttctttgccccactccctgctgcggtacccccccaccccaaggggccctctagggtcaggccatcttcaacagcaaccctatcatgctggtcccttttcctggtatagatttccttcaccgtatgcatgtatcatggtctgtgcattttggtgatttgctcatttgtctcctttccccaaaaccatggttctccatgctgttggcctctgggatcacctgagtggctactgaaaatcccagtgccccattgcagagcctggtgcggcaatggctcacacctgtaataccagaactttgggaggctgaggcagatggatcacttgagtccaggagtttgaaaccatcccggacaacatggcaaaaccctgtctctacagaaaataataaaaattagccaggcatggtggcatgtccctgtcatcccggctactcaggaggctgaggtgggaggattgcttgagcctgggaggttgaggctgcagtgagccaagatagggccaatgcagtcactccagcttgggcaacaaagggagaccctgtctcaaaaaaaaaaaaaaaaaaaaaaaaaaaagaagaagaagaaggaagagaaggagaggagaagaaggagaagaagaaaatgtcccattgcagagcaattgagtcaagatagctggggtgaggcccaggtatcaataatttttaaagctccccaagtgattccgatgtggcgaaagctaagagccccctgaactagactgttggctcccggaggccaggaccacttctatcttgcttaacagcatctggcatcactgtctgatgaagagtaggtcctccacaaatatctgttgaatgaataaaccattcaacaaaatatttccatttaaaaatttttccacgtagcaaaaattttaaacacagaagatttccaatgaaaagtgaatttcctcctttcctaggctaagttgtcttaaaaagccaaccagcattaacctgcgggtggggaggggaggaaaagggtattctctgcagagggcacagccagtgcaacgacctgggggtatgaccctacttcagtctctgaccctctcaagtttttacaccttggagattctccctcttaccgccttcctcaggatctatcagcctgggccacacataaccttaccaggtgcccttccagaatgcccacatccccagaaattcagattctctaaattttcttcaagcctcagtttcttcttcattctatgggggtgattattcctgcctccacgggtaggggtagtgttctgagcacctaatgagatagtagctatgaagtggtaaactgtaaagagctgtgaacttgacagttgtgtgccctctctgtgccaggcatgtgccttgttccttagagatgccatgtcattgaacctgtaccacggctggaggtgaactattattgtactgttttgcagactgggaaacagaggctcagagaagtggggtgacttgcccaaggtcacccaacctggaaccaaagccaagttttttcatctccaaaggccacggaaatcgtagatttaaggactttcagcccccaagtaccaggtctgttaggtttgaggatccccagccccgagagcactggtggccaggacagggcagacagtctggtttcacaatttatttcacccccacccagttgtttgccaaagggaggggtggggcggccggtggctgggagcctgggccgcccagtcacagggtagacttgtctgcctgccagccaatccaggctgccggagctggcgttggaaaggccctggccccatcttgccgggacactctatctttgtccctgaacacaaaaggggccttgtcttggcccagcagtgctgattccacatgctcccgactgccccagcccctctgccacgagaaaggcccactttgtcgagtcaaaagactaacttgtttctttttcaccaaaacgtgttgactgacctggttgatttatcttgggaaagtggtgaatgagggaggggagagaggtgacagagacaggcacagtccagaaggccatgtatcctggcctgacttgggggtgggcacccagcccttacctgggacagagggatagccacataatgtaatttcaggggattaggacagtcgtccaacctcactagtagcagagattccaccattaggtattcatttctttggctttaccctttgaagacagctaaaaataaaaactccctttgaatgggaatgccctattgtcacaagtgagtgagaattagttttcctgagaagagaggtgagtcagaagagaacaagcagcaggtgaggcggggcagcaggcaccaggagcccagagggaagctgggagaatgaggagggactactcacagaggaagtgagattacgtgagggaggaaacaaaagcagacttttctttggtaatttttcctcaatatcaggccttctccctccacaaccagcaacaccattgcttagtcttcttccttcctttcttccttcccttcttccttcccttccttcccttcctttccttcctcccttccttccttccctccctccttccttcccctctccctcttcccccatctctctttcctccctctttccccccttcctccctctcttcctccctccctttctcctttctttcctttctttcttccttctttctcctttactccattcaagaaatatttatggccaggcacagtggctcgtgcctgtaatctcagcactttgggaggccaaggcaagaggatcacttgagcccaggagttcaagaccagcctgagcaacattgtgagaccctgtcccaacaaaaaaaaaataataatttttaaaaagccaggggcagtgggctgcacctgttgtcccagctacttaggaggctgaagcataaggatcctttgagcccaggagttcgaggctgcagtgagctatgattgcgccactgcactccaggctggctgacaatgcaagaccttgtctaaaataaaataaaataaaaaagtatacagttatatatttgtaatataataataaacaaaaaagagaaaatattatgatccccacactatgctgttaaaagagagagagagaggaatatttattgagtacatactctatgccagggactcttttaggcaccgaggccataacggaatctcagacccctgtcttcaggaagtgtccactcttcctggtgataaacaattaagtgcatgactaacgatcattctggcaggggtacgtgctgtgaaaggatggggcagggtggcgaggcagagcagctgggatgcggtggaaggactgggttggccgggctccctgaggaggggatcatgctgagacatgaggggtggaagggaccagccgtggggatgctggggacaagtgttctaggcagagggaactgtacatacgagggctccagggctgggccagggtggagccttccagatacactgaggccaacggcattggcttcccaccaagtgcatggaggggcgacagcaagaggaagggttcagagtggcaggggctggacccataaggcctggtggttcctggtcacatcctcaggtttttatcctgaataagatgggaaactataggagtgtgcaagaaggtaacacaatctaattttttttatttaaaaggccccccccggctgctgtgtggaaaatggatggaggaggctactgcagccatccaggtgagagctgtcagcagctaggctacaggcgtgacagtggagcaggggagagtgggcagagttgagatctgttttttagagctaggatccagaatgaatgaatgaatgaatgaatgagcccctgagggataaaatttaggctcgagttcctgtaatgccactgagtttcagtgtgaccctgggcagatcccttcccctctctgggcctcagtttccccatctgtaatgcaaggcacaaggagcctgggacagctgacgccaaggtctcctgcagcattcctgagcctctgacgcttgcaggggcggaggctgtgatccagttactaatccagtcaggcctggctcatccaagggcagctgcagaaacctgcgggtgatgcattgactcacgcgtggtcctctgctatcagcagaaactgggacagccaggggcctgagactcacccgcaggctgggaaaggttggcaggatgcctctatgcagctgggggaagggagcaggctgccagcactgggcttcctgagcccctctggggactgatgtgacagccactgcagccaccgcagccaccataccttcccagttggcccaagcttggcatggggctgtgcccaacctctgtgggctaccaggagacactggcaggagcacaggacctgctgtgtgcccactccatcttctctctgccaggcacttgatgaagtagacagtaatactcctatcttattgatggggaaactgaggcacagaacattgtaggtggccaagccaggagaatcctactatgtttgactagttctttccattgttctgctctgcctccccagtatgaagcagacgggtgtgaaagagaaaggaagaaaagctaaatatgttttaataaatatagaaactcacaccctcatgttttaccagggccgaggactttcaaagaaaagcttcttctttttgcaacctttttgcaatgtggctaagccacttggccattgtgcacagctcttttactgctcatttattcattggcaattgcagcaaatatttatcaagagccttctacatgccagagactacgtgagtctctgaggagggagacacgacgattagcaaaaagcgacttcatatctacactcaccggcttgtattacatagagggtgagagagatatcaacaaaaaatttggaaactctacagtcatttttaaattctgcttcgagtaagttccttccttctctgagcttcagtttcctcattataaaatgggatagttagagttcctccctcatgaggctgaagtaaacagttgatgagatatggcctggcccacaatatgtgctcattaaatcctagttgttgctgttatcagttcctgtgtatagcataacttcagtagcctagtaggtaataactgtgttaggatggcccactgaaaagcagacgtcaagattgagttcaacatacaagagatttattgagagagggagcaggagaaggcaggtctggcacctggggaaggacagggagaaggaaggcagattgcgtaggaagagtcttgaactgcagtacaattcaaaaaaggttaagccatgccaatggagagtccttgagccaaagtcacttactggaagggttcttcatctctccagagtgggcctgcctttagtattcctgccatgctcggtggttggctgacagcagcccacaggaaatgtgggttcagcacagatatggcagcacatcccaagggacagcagctggggccgtcagtcaatcatgctccccacggtaggagacctgagcagtgcacgttcatggctgccgcagtaaccagacttggccctggagccagagggttccgaaactctgcacagcccatcaaaatgagttcatgcagcattccgtgccctcagtgtgatacattaaccagccagggcatctatggggagagtacttggccagcatcaagaggtgcacaccttggtcaagttttagattgtgcaaggtggaaaataggatggaatcaagaccactgggggcccacttggaccaggcactgctgacgtcaggaagggaggagttggaaaggcacatccaaaaatctactcaggagatagctgccaagagcctgtgctgttcagaggcaatgaactttcccctgaggaaaggggaaaggggctccagcaccatgcaaggaaccgtgctggggcgctggacccctaaccccctactggaaggtttttgggtttctatggaatcttctcggctcagtgtgggaaggggacttctcacccatccagtccaaccctctcattacacagatagggaaagcgagacccaaatgggaacaggagctgcacaaagtcccctaagagccactggctgaactgaggctccagccaggattcccagcacccaggccagggctgggccccctgcgggcaaccctgccagcatctgtcaagggactactacaggaaagcgggaggagggcaaaaaagagactgatctccggagagggagctggggctcggagggcagacagggagatccgaaaaggatggggagactcagaaaggaggctgaggtctgagaggggcatgagagcttggagagcgtacaggagccctgacagagggacaggggctcggagatgttgggctcaggctctgagggcctacagtgccccaggcagcccggcagctctggaaggcagcagcttcctctcctctcggcacttcacacccctgcagggccacccggagctggagggactgacactctcaggcattagtcagctcgtggcggttaaaaaaagaaggctcgatggcacttgtgaagaacgtctcttccagctttgagcaccaatgggctgccacctccccgctgcaccactggccaaggatagaggaatcgggaacagggcggagggcccagaagctgggacccctaccccaacgagggcttcctcccagctcccacctcatgatgatgatgataataaggtcagcaataccattagtagtagtgtttgtgatgtagtgtagtagtagtgttggcacatgcttgccactggcccaggcatgtgaggagggctctgaccctgaacttgccctgagtccattcacatccagatgtcccatctctggggctgtgcatagggcatcccctgcaacagcctggtccgaaagtgacccatgtgcaggtgcaagctacaaggggactcagaaggctcccacttcagccaccacctcccacttcacagataggaacactgaggctcttggagggcaacagtcatccaatatcatgtggcaagttgcccaggtttctgtccccagcccaggggtaattccagtaagccaactggtcaggcacccaggttcaaatgtgggctttgcactgcttgctgtgtgaccttgggcaagtgacaccgcctctctgtgcttcatctaaaaatagggataaaaatacttacctcgagtgaggattagaacataaggcaggcatccggaatctctttttgactgctgtatgcatggtcaaaagagcttaaacagcttaaaaagcctgacccccagcaaaagtgtgaccaatgatggttaacatgagtgagtgctggttctgcctggcacatgtgaagattcatgtagtccttagcaatcccacaaagtaggtatttttgaatcccatcttccacataaagaaatttaaatgaggcacccaaggccacagagctggaaactggtagcatcagaagctgaattcaggcaggtgagcactgtgctaagtgctctacacaaatgcatttgttcactcattcattcatgtaacaagcagtaagcacctattatacaccaggtactgctttagataccatgcatacagcagtcaaaaagagagtcaggatgcctgccttatgttctgtttctcatttgtggtaggtatttgtgttatctatttttagatgaagcacagagaggcagtgtcacttgcccaaggtcacacagcaaggagtgcaaagcccacatttgaacctgggcctagctgatgcctcgttttctgtcctgagggacccttttccagcaatatccccagaagggactgaaccagaggtgtatgcactgatgtctgtccagggttcaggcccattcagagccccggaacactccatcccacgcagccttagcctcatttcccaagtggcaagtggcactcaggccccaccctctccaagctgtcatgaggattccttccttctttcctaacactaattgagatgcctcctgacattgtacagataccatagtttaggaaacccctcctcctttcctagaggttagttttgcttcagtctgcagaagagaaaacccaggggtctcagaggtgacatgatttaactaaggcagtgactcaatcagaattcaagcccagacatgtgtgcctcaaagcagcagcagtcagggtctcagcaggagcagatggcaccctccaggtaggtcatttgatttgattttaataaagggatcacttaggagggatgagaaaagagtatagcaaaccacaaaggataaggtagtacctcagagctggtgcaagtcgaactattatgggctcaaagggtgagaggagggagaagggagaagttggctgtcaccaggagataagagagagcccccaataggagatgtggccttcagttgaaggacacaggcagcttgaggggatcttgaaggcagagaactggggaataaatacaccagcctcactatcctctctcttcccagatcccaccagtgctcccaatgggccagacccaatggaaagccagacaacaagggttcccttgattgacataatccctgcaggccaaccactcaggacagagagcaaggagaaggatgggaagaggatctgagaggagaaccacaagatctccagccaaagtcaagtacactttccttatctactgccttgtgcttgcagaggcatagtaggttctgttgtctatgccagcaaggtcactatggaaggtacagttgtcactacggctagttcatgctgcaggaacaaacaactcccaattctcaagacttcaaacaggttggcaaactatagcctgcaagctggtcactcatcttgtaaacaaagtttcatcgagacacagccacaaccacccatttacgtactgtctgtgcctgctttcttgctccaacagcagagttgagtagctgtgacaagcctaaaatattcattctctggccaagaaaatttgccaacccttggcttaaaaaaacacaggtttgcttcttactccggttccctgtccatctccagttggcaaggcttctcctccataacgtccacagtcaggggcccaggctggcgagccctcccttgaagaacccgccagtctccctggcaggggatgcagacaaaaaattgctcaccagctcttgaggctcccatcagaaagagacacacctcacttctgctcacagatcttggcagaaatcaagtgccaaggacgtgcctaacttcaagaaggctggaaagtacagcctctccacgcaccccacatgaggagacccagaaatggacccagatggtggatagcactcctgacaactgcggcatgcgaacacggcaaacggttgtaaaacaaaggaatgaggacaccgctgggtcttgcagcaagcttctccagaatccctcctgtgcacagggctcagggaagccagacaggattacacccgggggtggagaagctggagagaatgcatgtcacatgcacgctcggccactacccttttttatggcctccatggaaacagaagcagaaaccagagggtccctaggagctccagccacacccacttctcattctctggggacaaatgtctgagggctcccttctctctccatcagggtccagaagctggccaaggactgaagaggctttggctcaatttatgactttattaccagtcgccttccagctgtgagcctccacttccccagctgcaacaatctgtgggtctcaaggtgaggtcctgtgactggcagcatcgccatcacctggaaactgattagaaatccacattctcaagccccacccagctctattgaatgggaagctctggtggaggatcccagaaatctggacttcaacaagtgtctccggtgattctgatgcttgaggaatataaggcacaaacgaactgagatgtgcaaagcccgggcccgcactgcttttccagcagtcctccccacctgcataaatgacagtttcattctggtttaagccaaaaacctggagccatcctagagggttctcagaccctaatcctgtggcttagcctttagaatatattcagatcttggcctccctctccacctccttcactctgcgtggccctagcctctgccatctgacacccacatactaccttgcctttctaacccccgctccctcttcctttgagccctgtagtacatcctcactccagcagccagaagatgctcttaaaaactcaatcagatgattccacgcttctgctcagaacctccaatggcttccatctcactcagaagaaaacctgacagggccgcccttggtctgattcccactgacctctccacctccccaacgccctgccgcttgcttgccgtctccagctgcactgacctgttctctgttcctccaacatgccaggcacgctcccgcctcagggcctttgctcccgctatttcctctgccagaaacccctctctagtgatccccacacggcccaagccctcacctccttcagatcaccgctcaaatgtcacctcctcagagaagccttctccgaccccgccatcctgcgctgccccctcctctggctttgtttttctccatagccctcaccaccacctgacacacatctttgttgtttctctgtttatagtctgcctctccccacgagggtatgagggccacgaagccaggcactgcctgctttgttcactgctgtatgcctcccaatgcctgaatattgcctggcatggagaaagccctgggtaaatatttattgagtgaacagacggataggtaggtagacagatggatggacggagaaatgctcattccttgggccttgctgtggtcagcacgaggcagcccccatgggcacgccccaagagttacaccacagaaagaccccaggattgagggctgggtccttgtatgccgctctgggatcagcaggtctgggttcaagtctcttgaattgacctgaaggaaatcacataacctctctgatcctcaattttctcatctctaaaatggggatgatgctgataatgtgtatcatgtgccttaaccttataggactgcagcgaggactaaacaaggtgcacgtgaagggttgcagcgtgatacccaatacctgctaaatccacaacacacaggaattactgctgcccctattgctttgctttcttctcaattttgccagtggcctggggtacttgggcagccatagggcttattgggagtataactggctccaaagaaagggacttgggtttgaatccttgcagctactatctcgctatatgactttgtgcaagtcactagccctctctgggcctcaatttctccctctgagcaatgggaaaagggtattgaaggaggttgttttgtgatccctgcaacttgcctccccaagtccttctggaggaccaagcccacgctcgccaagccctctcctcttcgtggctgcagtggggaggccctgaagctgaggaggctggctggggctcatgctgactcctcccctagcctcactgattctgcagggagggaagagagaggcagtactgggttgtggctgaaagcaccccaactccatgtctaaaccggagttctccctctggtttctgtgatttgagtgagtcacttaacctcttgtgccttagcatcctcatctgtgaaatgggaataattatcacctatgaggataaaataaactgctgcgtgtaaagtgtttagacaagtgcttggcacacaattatcactattattataatagctgctattatttctaacaaccacagctggtctctggaccaggcaccatcagaagtttttataaactttgatttaattttcacaaatattctacgccattattgtctccatttgagaggtgaacaagtttggctcagagactgaagccatttgcccagggtcccacagcttgcaggtggagctgggtttgaacccagtgcactctcaagcctggttctttccactcaccatgctgctttcccttcgctctccgttttactgatggggagacagagggttacagagctcactcccaggcctcagtcctgctgggccctttcacccaaagcattcctggatccatgcaacatcgtacctagaggcagaactagaggccatgatgactcctattcacaaagaggctgctcagtgtgaggggcagagcagaacctggcctggctgccaacaggtgcatggccaggtctccaagggaagtggccccagcagctcccaggcagccagccccccctcagctgggcagcccctgatcctcctcccatccccctgctttatgacctgttttatgagcgggaggcctggcagcttccacgttgccatgggaaccagcccagtgcgggctcctggcagctcaatcagggattggcaattttaagtcaggagccaatcctggggctagcgagggtttccatgggttggggtctgtgggccccagggatgcacagtgcctgcctgactgtctgcctctctcctctgctccagctccccaggtgcccaaagaactcagggaccccacagctggaagatgacaggctgttagagccctggaggagcctggggcagcagggaatgacatggaccaccgagtgggggctgggagagctgacagagctggaccgtggacacacatgcttaggggcacacagagacactaggacagctgacatgaagggactcacaatgatatacagatacagactcacacagagaaacagagatatgcacatggcagccacatgtgcatagcaaagaaaggtacttgcaaacacacagacatacacaaatccataggaatacctgggtgcccagagactcacagacacacagacatccaaagacacacacagaggacacttggacacccagagatacatccagacatacacatagacacacaaaggacgtacagacacacactgctcactgcctgtgtggtccaggcagcttgcccaaactctctgagacccaatcgcatcatctttcaaaagggcatcacaatcctagcttgtgaggacagggaggaataacgaggaaaatggctgcgtgtgctcagacaccttcattcatccagccagacaatattattgagcatctactatgtgccatgtgcctcctccgagctgagaacaggaagctaacaaggacctaccctcaggaagctcacagtctccttcggaagacaataaatacaggaacaaagcaacagctaagagtgactcggaagacaataaatataggaacaaagcaacagctaagagtgactcggaagacagtaaatacaggaacaaagcaacagcgaagagtgactcggaagacagtaaatacaggaacaaagcaacagcgaagagtgactcggaagacaataaatataggaacaaagcaacagctaagagtgactcggaagatagtaaatacaggaacaaagcaacagcgaagagtgactcggaagacaataaatataggaacaaagcaacagctaagagtgactcggaagacaataaatataggaacaaagcaacagctaagagtgactcggaagacaataaatataggaacaaagcaacagctaagagtgactcggaagacaataaatacaggaacaaagcaacagctaagagtgactcggaagacaataaatataggaacaaagcaacagctaagagtgactcggtggaggaaccggttagggtagtcagggaacacttctctgaggaggtgacattcgcctgagacagaaggaatgtgatggaactgaccagaaagggtagagagaagagtgtcccagttagcgggaacaggaggtgcaaaggcgctgaggtcagagcagggctccatgtggccaagaagccccaaggagatcagtgtggctgcaatggagggaggagacaggggatgagtttgagagtaactggaggccggagcaggcagggacttgaagactgagtgatgtactgtgggtttcattctccataaaatgggacccacaaaagtgtttctatcagggatcatctggtcaaaatcgcattttaagtagctcactttggctgctggcaggaaactgcctggatggggcaaaacaggacatcgggagcctagcattgggggctgtcacagcatccaggggaagggtggctgcaggctggaccagggtgatggcaatggccatggatggtccttgaaattgtgcattcagcacatctttactgagctcctattctgtgccagccattggggatgcagaagccaacaagagagaaattcctgccttcacagggcatgcaatctagaggaaagagaatggtaactgaatataatatatgccagtggtaagtgacgacaagtgctgtggaaaaaatcaaagcagggaagggtgtggagatctgccagggaggagtggggcaatttgtagttttaaacaggagagtcgggaaaagtctcattgaaaaggccacattttagtgaagatgtaaaggaggcatgagatagaatctgggacagagagttccaggcagaggaaacagtgagtgcaaaggcccggaggcaggcccactcctggtttgtttgaagaaagcaaggaggtccctgtggctgagctgactaagctggtgggggcgggacagatcatgcagggaaggaagggaaggaggaaggggctgaatgggcagaagagactgggacctggatgcctataggagggagggaaaccagcgagacagggcctggccccttctccatcctgctcccccgacccaaggaagcagcatctcccattcctcctttcatcccacaaagcttcatcagccaaaaagtgaaagtttaaaaagggaggaactgatcccaggagaggcagggccctgagatttgcctgaacccaggtcagaccccagcccgggtggggtgtgacttcctgtggctctgatggaattctcactgtcctcctcaggatgcattcctgggcctgaggcacagaaagaggacacacagccaatagcagccagtttcagggctcctaagcctgctgggagacacccccagcctcaggcagtgctgtcggggtgggctacctaagctgcaggtgagaagaatggtggctaattagggtgctgcctccttctcactctccaggtcccagggataccctgagttggatttcaggctcattaatgtcttggcagagaggctctggctgtgagctctctccagctgcccagccttgcctggcaggagtagggaatagaagggagactcacaggggagtcatctacccccagagtcagtcccaaggcaggcccagggttgaaggacgtcctagaggacgtcctagagcccagtgacattggctgagacactctccctccctgagcccctttgtccctgtctctccaaggggatcataggccttttcccacctgacttccagagctgggatgaacccaaataaaggatgaaagtgaaagtgccctgaatcattaaagagacaggcagaactccctgtgccaccctggagggatctgcaggatgggttgttacgtaagacaaggcgccttgcaacaactgctgcctggctggcctcccagcttctgcccttccgtggtggctgttctcccctggtagcccctggattctgttacataaaataccaggtcaaagaattcccatgggacccagcaattccacatctggctctatacccaaaagaactgaaagcagcgtctcaaataagtatccgcacacccatcttcatagcagcatcattcacaatagccgaaaggaggacgcaacccaagtgtccactggcagatgaataaatggataagcaaagtgtggtatatacatataatggaatattattcagccttaaaaaggaaagaaattttgtcacacggtacagcatggatgaaactcaaggatattatgctaagggaaataagccagacacaaaaagataaatactgcatgattccacttatatgattcatcttgagtagtcaaatccatagcaacgcaaagtagaatggggctgggggacgggggaattcgtgttgaatgggtgcagtttcggttttgaaagataaaacagctctgcatgcggatgatggtaacgattgcacagtgatatgaatgtgcttaatgccactgagctgtacacttaaaaatagttaaaatggccagttttatgctgtgtatattctaccacaataaaaaaaattgcaccaaaaaaccccaatgaaaccaatcctagctcagtcctctcctctgctccatcttcctgaggctctggttgtatgccccaacctgcattccccatgccaccccatatgttctgcactgcgcctccctgacccatctcctgcccctcccctcgctcactttgctccagccctgctggcttgttcactcgttctccaacccactaatttcatgccatgcttggggccttggcacccaatgtcctctctaccaagaatctgtcctggatatctgcagggcttgttcctccccatcctccaagctcaagtcaaatgtctcctcagaggagacatttccttgaccccctggactgaaagcacccccccacaaccccactcctatcctcctctatccctttacctaaatgtatgtctttcataacatgtattaatatcactacctggaagaatactttagctttgtctgctggctactctgttagagtgtcagctctggagggtaggaatctcactttttcatgcctcacaacaatgcctggcacatagtaggtgctcaatgaatagttatcaaataaatggagaatgatcttattgatgtatgatgcatacctatgacacacatgttatatctgtgcagatgtaaatatatgggaaaggcctggaaacatgtccaccaacatacagtggtgaaccggggaggagggtgggcaaagaggatgggggagtggctgtcaaggggccctttcagggttcactgagttcactcagctgctgcatgcaactcttaccatgcagatcataggtatgtgagttttaaaaaagagctctgaggtgatgctatgtcccatgtagcgtctatgagtgattctccccagcctcccaactaccctgcaagggcgttgttactcctacccttctatgaagcgaagcgcattctgcattccccagagtcaccgagctcctgctacacaccaggcatggttctgggctcgggagacaccagagtgaagaagcaatcctgctctcatggagcttacacttcagtggggcagatgaacaataaataaataattaaaacaagtctgttggggcagggaacagaatggagaagtgtacagagtgaaggggcgagagtagagagagcaagggaggtgagtggaggtttgcaatttaacagcgacaccaggaaagccctcactgggaaggtgacatttaagacctaaaggaggtgaaggggtgctctgattttactgtgtcccctaaagctcatgtgttggaaacataatcctcaatgcaacagtgttaagaggggcactttaaagacatgatcaggtcatgaggactctgccttcatgaatgaattgacgctgttatcacaggagtgggttactgacagagtgggttcctaggccaggcgtggtggctcacatctgtaatttcagcactttgggaagctgaggcaggcggatcacctgaggtcaggagtttaagaccagcctggccaaacatggcaaaattctgtctctactaaaaatacaaaaattagctggatgtggtgtcaggtgcctataatcccaggaggctgaggcagaagaatcacttgaacctggaaagtggaggttgcagtgagcgagattgcaccactgcattccagcctgggcggccgagtgagactctatctccaaaaaaaaaaaagacaagaaaagaaaagaaagagagagtgcattcctaataaaaggatgagtatgactcccttcttctctctctttctttcccaacccctttgtccttccaccttctgccatgggatgatggagcaagaaggcccttaccagatgcagcccccctggattttggacttcccagcctccaacccatgagccaaagaaaatttccattctttataaattacccattctgtggtatagtgctatagcaacacaaaacgtacttagccagggatttatccaggcaaaggcaagtgcaaagtccctgaggtgggcacatccctggtgtacaggagcaatggccaccgtggctaggacacgttctagggggagagtggtgggcttggaatggtgaaatcccttgcctcacaagtagggcagctgagagcaatatcttgggcctgtctgactgtaaagtgaagcttttaactgcaaagggcctgacactctttctagtgaggaaagccagaaagggtgagcgtatgttattaccaggcattgcgccaaacacgttggggaatcacatgggggaagcccccacccttctggggctgctgctgccgtagagaggaagggaaactgagaagtcagctaagagcctgagcagatactataagaatccatcgtgattgctgttttccgtttctctgtgtgttggttgtggaaggagtcttagcacgtgtacacacagcatgtgcattcctacctctgagtgtgtctgcctgagtgtttatggctgcataggggtcttgagtctgctgcccacaagttaaacagtggtttacttagccctccccaactgtgtgaatgcaagtgtgcatgggcatcttcatcttgtctttgtgtttatacatctctgtgtttatacatcccttgtctttgtgtttatacatccctttgtgtttatacatcgtcttgtctttgtgtttatacatacctgggaaggtatccatgttcatcaggaggcatgtatccatgtctgcatgtccaaaatgagtgtgtgtcattgtgcatgtgtttcatggatctgcacagctgttaagagttctgtctctgtagcctgactccctgggttggaatctaggtctgccacttactgggtatgaccttgagcaaattactcaaccccctctctgcttcactttccttatcagtaaaatgggcatattaataaaacataccttataaggttgttgtgaggatcaaacaaatgaatatatgtggaatgctcggattgatgcctggcacatactaggagccatgtgtgagccgttgtgatgttagggctctttctgcgtgcatgtgtctgtctgggtctatctggctgactgagcacacttgccccagctgatatgcctcgtagcatgcaagttggcatgcctaagttcacaccttacctacgtctctgtgtgcacaacctcagtcttagccccgcatgtgcagtgcccagcctcctctgcctgacaagagcaaatgtggctggctggggtggggactggaggaagggccagcaggagggggctcctgccatggcctggccagctggacttttcacagcccagtgactttgtccctctgatcggccaagtggctagacaggcaggcaaaggaagtgcccctcttccaggctgtccccggcctgtgccatctctatccctgatcacagggattgggtttacacgcctgatgcccctcgggattgggggatccaagagagcagagtcaggcctgagccacctttgtgtccccacatcatagctgtcactgttaatgatggctaacacttactaaggactggctgagaggcaggcactgtattggttctgtattgatacatggtctaacttgccaatcctcatgccatttccctgagataggtccttccattgtccccacttcatgggtttggaaactgaggcacagagaagcgaattgtttacttaactcacacagctggtaagtgaagagaccagaatccaagctgattaaatacatgttaagtgacccagctcattgaatgagacacagaagagccatgtttgggatggagtggaaagatggagaacaaggtggagagtggttctggcagaggaaggggccagcttggctctctgcaggggagccctgggaatgggaaggaaaaagtggatggggccagatggtaggggtctggaaggccaagtggggaagcttgcatctgagctggctctactcttcagagacctggccacagtgaggtgccatggggaccggccacctggatccttcattgtgaataaactggtgaactgagcccaggtctctgggagagctggtagctaaaggcagactaacagaacaaaagctctgctgtcagtctgaggttggaatcccaatgccctcaccccctggtcacttcctactatgaaacttccattttctcatccaattcaacttgttaaaatggttaaagtcatccattatcccaatgtctgacatatagtactcaataaatgatcatccactctgaaacaggggctttcaaataatggtaataaatagattaaaggatctagcagaaaaggtagacaacatacataaacagatgggaagtttcagaagagagaaggaaactatgagaaacaaaagagagagagagctgactggaagtgctggaaccagcaagaaaaagataatatcaaagaggaagaattctgttgatgggattagcaacagactggacacagaggaggaaagtgaaacttagtgatgggtcaacagaaattctccaaactgaaaagagaaaagaatgaaaattcacaacgtagctttcttagatttgttaagagggtgaaggccagtgtcagacacattggattaagtagtaccattccttcaaccatttaacagaagtacattgagctcctattatgcaccagacagtgtttacagtgctagaatctcaacagtgatgaaaaggacaaggtccctgccctcagggagcacacaacctaagggaaggatcagactcctaaataagtaaaatacatacatagtatattagatggtgtattagtctgttctcatgctgttaataaagacatacctgagactgggtaatttataaagaaaagaggtttaattggctcacagttccacatggctgaggaggcctcacaatcatggcagaaggtgaatgaggagaaaagtcacgtcttacatggcgcaggcaagacatcttgtgtaggggaactcccctttataaaaccatcagatctcatgagacttatcaccatcatgagaacagcacaggaaagaccaacctccatgattcagttacctcctactgggtccctcccatgacacatggaaattatgggagctacagttcacgatgagatttgggtggggacacacccaaaccatatcaggtggtgatgtgtcctatggagaaaaagcacgggagcaggccaagaagagtagattcaggggatgcaattttaaataaggcggtaggtcagggaaggcctcaataagaaggtgacatttgagcaaagacccaagggaggtaatagaggaaccaggcaaatatttgggggaagagcattccaggcaaaatgaacagctggtgcaaaggtcctggggcataaatgttcacagacagttatgccccagggaaagcccagaggctgaggtggccagagaggaatgatcttgaatgatggaaaacaaggtcagagaggaaggtaaatgggaggtggccccccaccaccccaggagggaagcagattatcatgtagggattttggcttcagctgtgagatggaggcctttggaggatttccttcaaaagagccacatgacctgacttctgttttaacaggattcctctggctgctacctggagaatggactggaggggcccagggtggaagcagggaagccagtggagagtctgtggtgacgatccaggtgagatatggcacctgggatgaaggtggtagccatagagatgatggcagcttttagatttggggtgcattatgatggctatgctgatgtcaggagagctcttattgtttttatatgtgttgctgttattagggctagccaggctcccacaaacttttttcaaggagccccaacccagacaagcaggagtgaagctgctcacctggccccacctgccaggggaatcttgctgcacttgttgggtagctggtggccaaggtccatctccccagagcccagccctgtaggctcctcaccctccaggcagcccagggcagctgcaggctcaaggttgctctgagcagcccccagctccacagctgtaaggttctagttgttggtttactcagaggcagcagattcatctggagaatctggtccctgcagccccaggtgccctcatctcacttcctaaacattcatgagaggggaggcgggcaacctcctcaagacacctcgactcagatgcctgattcctgccgccacttgtccacagcactgccccatctggctcctgccctccacctgacggctgtcatgggctcctgctggtacccctgcatccatccaaccctttcccatccaccccactaagagcaggaatgggccattctgaagagggtgacaatgtcactcagcgagtgcttaaaactccaccatagctccccctggcctgggataacatctagaacattaatagtggccttcaaggccctgtgtgatctggtcccactcttcatggccttcttgtccccccaccccaccaccacagtacttgccagctgtaagaagctgtacctaaagcacccctgcagaactttgcacagttgctcctccaggttgctctagcatggaatcctcttcctgcccttctctacctggcaaactcccacttctctgtcacctccagggtcactgccgtcttctccagatggctggaactcaccccaggctaggctccctgctggctcccacagctccctctgctctccctccttattcagctgcactatattacaaggataatgacaacacattggcaggcatgccctgctcccattgtccatggcagacatcactaaacgatcagggtgttcttcccccctgagcccggatatggcctcaggaatgcagcattctagagctcatggtaatcaaaaagaggtcgggtgcagtggctcacacctgtaatgccagcacttgggaggccaaagcggaaggattgcctgaggtcaggagttcgagaccagcctagccaacatgacaaaactctgtctttactaaaaaaaataaaataaaaaattagctaggcatggtggcgggcacctgtaatcccagctactcaggaggctgaggcaggagaattgcttgaacctgggaggcagaggttgcagtgagcagagattgtgccactgcactccagcctgggcgacagagcaagactccatctcaaaataaataaataaataaataaataaataaatataaaataataaaataattagaaagcctcctgagtagctgagattataggcgcccactaccacgcctagctaattttttattttatttttttagtagagacaggatttcgccatgttggctaggctggtctcgaactcctgaccaggaggctgggagggggtgtaggaaaggcgggagggggtgtaggaaaggcaggaggcggtggcagccgggttggcggggtggggtagggggtggggaggtggggaaggaggatggggttggttatcaggttctcgtcctgaatggctctgcctctggctttccctgtagcttgggcagatgccttctctcgggacctcagttttcacatctgtgaaatgtggcaatagggccaagttgtcagtgacattcttcccagatgtctcccaagtgtcagggctggatttataagcacctactcagtgccaggccctctgtgttgtcctggagaaagagatgaataagacacttaaccctgccctccaggaagccatggactaaaggtgaagggagtgtggtgtgtgtgtgcgtgtgtgtgtgtgtgtgtgtgtgtgtgtgtgtgtgtgtgtgttgcatgtaggcaactggggatgaaaaaatcagttttaacctgtcacccagctgaggctctctaggctacttggagcttcctggaatttcctttgtgtctaattgcaattagcattctttcctgtctagtagatgcaatgtgtccctcgggaggaaacgcagagaccactgcggagatgttccaggaactgaaacctttgccttccctttagacttgcctcctaactccgtctacattaaccatatgtctaatctcaagtcaaaaattcaaggtttatagggtaggggctaggcttgtcagcatttcccaatgatgtcctgtcccacgataaaacaattctggggacaatacattctggaaatgctacatgaaatctccccctcttgaagcttcacattacacatttgcatatagaagaatctaagggaagcaaaaaaaaaaaagtttgtcaaactttgcttaatccagttcttcaaacttatttaaccacataactctttttctcaaagttcctgtttgcatctctgtcagttatcatgctttaacttgcatcagaaacctcagtcaagctggtttatgcaaccggaagagtacattagcttttgagactgaaagtctagaaaacataagggcctcaggtagagttcaatcaaggcctcggctccatctcttgaggcttcccttgtgtctctatccccccttctgtacactcgtaagcttcatcctcagcctggtttaccccataagaacaaaatagctgcagcagttctgggcatcatattcaagtaccccactgcacaaagaagaggagccttctcttttcattacagactggatgtccttgctgtatttagaccatgtacttatctctgagccaatcactgggcaagagaaataaatgggcatcagccaatgagagcttacccctgggatgaaatcataacatcttccacaaagcctatgacaatgtcttccttctagtaacacatatcccagtaatctcagctatcccatcccattctttgctaaggaaactgatttgtgtccacagcactggtgagccactgatctcaaagagggtaggcccctaacatgaactctgggggtgaatcttgattggtccaaagatcatggtaaccttatttctcttcaccaacgattggttcagagatggccataggacttggttctagctaatgagatgcaagcatctcctgggtggggcttctagaaaagcttttgtcttctggtgcaaaaaatagacttagatggcatattcctttgctccttcacctttccttcttcttcatacctggaatgaggatttgatacctggaggtgtggcagccatcgtgggaccaagaggcaaaaactgcaagaataaatgccacagtcccagagactgcagaacagaaaaatagagcccaaaggctagacaacattgttgggcagctgtgcatagtctggaatgctatctcttgacatcttattatgaaaaattggattggaaatacatatttgtttgagccaaagacattcattactaactgaccaaagccaagtcattttttgtaaaataggacttgtgagagccttgagacacagccttgaagacacagcttgagtatccttgaattccagatactttcataaacaagttctgcccaaagatgttataagaaagcagattgtccaagctttgcatccaccccagcaaagagttgagtgttccctgtgtgagaggggcaccaggagtcatggagcgtcaggctgggagcccaacaaatcccatggcagagtgtcccatgttgctttgaggtttatagaggaagctatgacaatgccaactcaaaagtacattcttgaattcagatactgattgagatgcagcgaaatctatccacagtcttaagctcatctcactcttcttatatcctagtaatcttacttctgagctctcttctgataaaataacccataataagcagagaaaaagccaggaacataattttcatgacagttacatttacaatatcctcctcatcctgccccagccccaccaaaaaaactggacaaatctaaatgtcctataacagaggaaggattttaaaactatctgttcagtggaatattacatgatcataaaaaatgatgtttgcaagtttataatattatagcacaggggaaaagccggctgtagcattatatatattatgtataatctcaattatagaaaaattgcatgagggaaaaatcaaccatgaaataaagacagtaacatgttaatagtgattatgcttggttaccgttattatgggtaatttgttggggaatttttcctgctgttatatattttccattttacctatatgttctacttttgtaagcataaaaaataaaactggctcttcttttaaaagcttccaggaccctccaatttgtgagatcattgctgttgtctctcctccagtaaagcaggtaatcaaggactgcccagagctggtgaccccattctgcaccaggccaaaataaaaacagcttccaactccagcatatttgattaacagcttgaaattctttcaagaggcaaaatgaatggtagggaaaggggaagatcaacaccctattgttaaatggtgatgtgagcttgcaggaactaaaggcaaaaagaggtacacaccattccctgccttatgcaaatcgatgcaaataggacacactctctggctaagcaagaattccaggtctgagctcccacctggatcctgggtctcactgaggagggaaggaagcagtgagaggagggcatagtgatgaccccattcattgagcacctactaagtgtcccacttgcaaagcattttcatggcctggagctcgtctaccactcatcaccgcttgtgatgaaggtaatattatcacccactgtttgaaggcaagtcaagtggagctcagagtgggaagtggcctatgcaacgtcacagcaggaccagccaactccaaagccagtggtatctgatgaccaggctacgcaaccctgggatacaagtgcatatggtgcctctggtgggatctagggtcagtcctcagtgtggaggagagaagagatgtataggttgtcgggaccacaaagcatgaaggtctggaactcctggatgcaatgttagacatccaggtggaatgcttgtaagtcccagacagactttggtccccacctggcctttacactcattgggcctggaacacgccccctgcagacacctactggctcactataattccccagtcagctctctgctaaaaggttaccttatcagaggggcctcagctgactactctacctaaaagagcatcacctgctcacctctcccagctccaacatctctatccccgccctgcttggtttcgcatcgtcgtgcttgacacccctcgacttactacatatgtattcgcttattgacaagaaagtccactccatgagggtagagagttaacttttgggctcagctctgtgtttccaacacctggtacatacttggttgttcaagacatatgtgtcaaatgaattaatgaataaataagtgaatttcaacttccccagagcctagttacacaatcttggacaatgacccagcaacaataataacatagttattaatgatacatcactctttataactaacgtttctgagcacttttttttatgagacagggtctcactctgttccccaggctggagagcagtggcataatcatagctcattgcagcctttgtcttgggttcaagtgattctcccacctcagcctccaagtaactgggactacaggcacacgccaccatgtgcagctaatgttttaattttttatttttttttagagacagggtctcaccatgttgtccaggctggtcccgaactcctggtctcaagcaatcctcctgccttggacagccaacatgctgagattacaggcatgagccaggcccccagccctgagcatatatttgtacattcctttcctcatttgatcttcacatcaatcatctgaagcagagaacgtaattatccccattagacagctgcagggacgaaggcactgggaaggcaggtgctgcccagatcagagagcatcgctagcagagtcaggacttgaatcaagcatgtctgattctaaaacctacttgcctacccaccatgtgatgcccaggtcaattccacccaacaagagggcaggcactacatctgccttattcttcgccatattcccagtgcctggcaccaggtgaattgcccttggaaaaggatgagagaaatcagtggttctggaagtgtagccccaggaccagcagcagcagcagcacttgggaacttcttagaaatgctgattcttggttcccattgcagatctactgaatcataccaatgcacgctagagtgtgagaaccactgggacaaatgggcgaacgtccccaagcctgatgccccatccataaagcaaggctgagcacccatgggatcagagggtaaaatgagaacttcagccagcgccagacctgccaggggtttgagctatcctgattccttcccacaagcaattggaggacaaattttcagctctaatttcaggcctttgatttcggcctcatctggccaggaagatgccagcttgtcagagagagtgggaggccaggagtgatggagctggagcaggagaatctattattaattaccatgtaacattgattaagagcccacaaggcaccacagctgcgaggagctcaggagagcctccgctcctgcctggaggggaaaatgattagcaacattatgaaaggaaatattcatcctgtagcggccctgagcaaacacctccagggatggggaattttcctctcccagtgatctttgctcctggagcgggggcagctgcctccgtggcctgggacagacttgtcgagctaggaaggtggagaagctgacctctgacccatctgcaggtgtcaggttgacaggtcagagagtgcagctctagggggccagagatgcccaacttgggctcctgaaaaagcagtttaaggtggcaggatctttctgaattttggaaagaaagaggcaatctggatttggttttcaattctccaaatttttaaatatggttaagacagattctgggttggcaacttctgtagctactcagctgccctcatcacatttaatccttccaacaactccgtctttatcttctagatgatgacactgagcctcgaagtggtcacttacatagcaagtcagtggagcagctgggattcaagcctatatgtgcttcctgaacctctgctttctctactgaatcactcaggtatattgaggtgccctgcccctggtgttccaaagccacccaaacaaattccaaaaagtttatgactattgcccaatccaagctacatccctgcaacaggatcacacccagatgtaacataaaaactcctagtcaggcaacatgtatggatgtgtgaatctgagcacctgaccattctaatacccacactgtgctcctcccagaagcttgagtgtcaaggagctggccccaacctcccagtggtcctgcttctgacctttgatctcacatttatttccaagaggatctagtggaattaaccagtcacctctccctttgctccacggaactctatttttttctgccactgactagctgggaagccttaagcaagtccccagccttctctgagattcaatttctccatatgccaaagaggactatttggatccagggatcaagctgctggccttattcattctatggtcaagccactgaccaagtcattcctaaattccagagtgagaacagagacttcataggtgataatgatgatgatgataaaaatgataccaagatactagttaactatttttaatgctacctaagtgccaggcactgcgtgtggattatctcttttaatcctcacagcaaccgtatgaagaaggtggtcttggtaaatgccatttcacagaagatgagactgaggctcaggcagaaaaatgactccagagcagacacgcagagcctccactctggtgtccaccctgtgccctctctcatgttcacaaaatgtgaggtttgttggctccttctagatttctccatctggaattcagaccataacaggtccctgggggctgagcaagctgctctgtttcccaggaaaccatgtggagccttgaagatttattaaggaattcataaatttgggggagagttttaaaactggtacagctggccacagatccccagggaggtagcaagctccccatccctgcaggtgtgcaagctgagaccaggcagtacatttggtggaatgttgtagtagggattccaacaccagatgggaggcaaagaggatgagctacatcagtgactttttggaaaaaaacaaacaaatacttgttaagagccagactgcctgaattcaaatccctcttacttttctgagtgactttgggcaagttactagacttctctttgttcaatttccttacctttaaaatagaactaataatagtacctacctgactgcattactgtaagattacataaagtaatatgtgtggaacacttagaagagtgcctggcacatggtaagtctataaagtgttagctattactttcaaacattttatattaactttggagtcctgtcttccattcgaaacttcagtggatactgatgttacaacaaataaaacaaagaaaagctgactgacctgaagaagtcaggggctgggagcactggagccctgtgaaatctgaccccctcctgcaatagcctgcaaaaacactgccatggcccgatgccaccacaggcgactgcacctcagtggctgcgtccttgctgtcaaaatccaatctgctcgggcctctcaaaactatgcattcagtgccacatttcacagatggggaaactgaggcctagagaggcctgctaaggttaccaaccagttaagagccaagttccctctggagagcagaggggctcctctgccgccttcccagaaaaacaaccaaccacaacaaggtcacagtcccagtgcgaactccactgcccctctcgacattgccacagagggacccagagagcctccttaatgcccctccctggtgcaggacctcccactgcaggaagctggttttggaggagggaaaccagcttttgctgggaaatcatcaagaggaagtaatacttagagaaaggaaagaagggtagcaggaaccagagctaagcctagcagaacgggggcaggatgaggctgcaggttgggggtgggggcagcccagagcctccacctccccacacagaaaagcttgatcagccctggcccagctccagacaccaagcctgggatcagcaatcctgggagagcccccaaacttgccaaaatttcccctgctcctggactctgctcttcctgtgataagacccattttccgggaagatgtgatcacaggacactctgcctgtgagtgtctgataggaggattccatctgagtcctctccgggaaggcctgtaagacccaaccatcaggatccagactctcatcgtacaaaggggacactggcccagataggggctcatctgaagttacacagcaggttgggacaaagctgggaccacccccaggcatttgaggccttactgttttcaccaacatcaaagtcttatcttagtaaccatagtcataataataataacaacaatcataagacggatatatatttatatgtacatataaaatttgttttttgagagaaaaagaatttcctgatttttttaacttttttttaactttcaggctcaggggtacatgtgcaggttcgttaatacaggcaaactcgtgtcatgggggtttggtgtacagaccattttgtcacccaggtactaagcatagtatctgatagttatttttcctgatcctcttcctcctcccgctctcctccctcaagaaggcccagtgtctgttgttcccctctttctgtccatgagttctcattatttacctcccacttataagtgagaacatgcagtatttggttttctgttcctgcattagtttgctgaggataatggcctccagtttcatccatgttcctacaaaggacaccatcttgttcttttttatggccgcattgtattctgcagtgtatatgtacattttctttatccagcctgccactggtggccatttaggttgttaagagctgtattttttttgaatgcctacaataaggcaggcactattctaggtccttcagatgattgaacattttccaccctcataaaggaactccacagggaagggtccgcatccccattttacagatgaggaaaatgaggcacactgaagttacagaatgtgcctgggaccacacagctggtattcggtagagtagggattcagacccggcagcttggcttcacaacccatcttgatcactacactgacagcaggaagaggacctgctttctggaagttccagcatcactagtgagcatgggtgaaggaggcttcagggtttgggaaatcggcctgtggctgtggaaactatgtgtggacagcttcctcccacacagctaatagttattctcatgctagctgcaagaaaacccagaacactaactttcccagcttcctttttaactaggagtggcatgtgaccctcgctgatctaatcaatgagatgtaggtagaagtctcagaaacagtcttcctccacagttaaaaagccctttcttttgcgtttatccctttcccttcttcctacatggaacagggatgccatgcccaagacctggcagtcatcttgcaaccatgaggcactaggaatgaggataaacagctacaggctaaagatggcaaagacgaatggcaagcagagcctgagtctccagtggcatcagtgagagccacactggtcccgggtggcctgcccaggacttataagacaataaacaccaattggattatgcctctgcagaagggtttctattatttctagctgagttcattcctaactttcccaagagtggggtcaagataggacccagggactgcctgtcaccgagctcttgttccctctatggaatcacactacctcccaggggatgtacctccccctttctatctcttccaaaatgcaccagcattaggcgtttgcctggctcagggcctagaaaagggtgctgagcagttgttcctcaggccacgtagccactagacctgcccatgtgaacccatgaggagtgggggtggggtcttgccctgaacccacctaccatgaaaattccagggtcccaagtatccaacagattggacttccaggaaacatatttgatttgacttgtaataaccatccatccatcattctaaacaaataatagcatacatcattctaaacaaatgtttattgaggggatgcccagtttcaggtgctcataagtgaacaaaatcagcaaagtccctgtcatcagaactcatatcctaatgggggaagcaaaccataaccaagtcagcagagaggtccctcacctttacaaggtgctttacagtttacttttaagaatttatctgtcctttatcctcattcctagtgcctcatggttgcaagatgactgccaggtcttaggcatcacatccctgttccatgtaggaagaagggaaagggataaacataaagggaagggctttttaaggagacctaacttcgcctcctcaataactcctcatttttccattttgccaaagaaacaaaggcacaaaacggggaccaagaagaggcttccccaagatcacccagccatgtccaggagggtcagtctggcagcaattgccttccccagggcacatcctctgtctactagaataatcaaataagtccctctgccatggggatctgttgctctgggcaccactgagacagccatcagaaacaacagcctctacccaaaatcagtgttgggctgggatacagcattgtcagctacacaaaacccccctcatcaagctgttggcgcctggtggctgcttaattattcatccctgctgaacatgcaggcccagggcttcagccatggtttttggagctcaaccatgggggagcctcggtgataagcccagacctgttaagaagtttggaatgtatgtgtctgcccacaaattgttccctggtcctcccacaccagcctcgtcaggcatagtgaaagatgacaatgagccaggaggcttcagagacaacagggcccaggctgtgtttgcaatgttggtagctaaaactgctcggcctgttttccattcccatctagcccaagatctttcagactttgagctaagcagagttttaggcatgttgtgagggttagtgagggaagggggtggggagtcatttcttcaggggagtggtggtggtggtgggcagtgactcaaagaggccaatgaacgtagagagaagagcttcttttgcaagatggacagagccaaacggacctggtttcaattggctctgtcactttccagctgtgtgtccttggacaagtcacttgccctttctgatcaaaggcctcaaatataaaatggagattcattcattgtgtaaatgtatattgggcccctgctatgtcccaggcactgcggatacagcagtgaaaagaacagccaagtcctgttctcacgggggcttgtgtaaagagttaatgtatctaaagtactgtgtcccacatataagtactcgattcatggtcattatgacttttgttattgtcagaggatttaagttttacacatacaattatttgctgttacccacctatatgattattattaccatggcagaaaacgccccctctacccaccccacacatatatacacacatacgcaactcacacctaagccattatgaaagaattcatttcctcctctaaagttgtctttggcattcatttttcctggtctgggagtttttaatttcattcatttccccttagtcctaacccatcgtagcttgtcctaacctaacccagtatatagcagagaccaataaatgttttcttcattccttccttcgttcattcatttacttgacaaacatttattacttcctccaacatgccaggccccgctccgcgagctggggaagcagctgtgacccaaacagacaatgtcaggcgatgtctctgctctcatggggttgacattccagcaaggaagacagacaacaggaaggcagacagacagatgacagatagacagaaaatataccacactcacaggcagcgcagatgctggaagagaaaagcagaggcttcaaggtgggggaggcaggacgaggccattccagactggctgggcggagagtccctgctgaggaggtgacgtataagactgggtgggacggagaagggagtcctgtgaacatctaggggaagaaagctccaggcagaaaacacagagtgcaaaggtacgaggaaggaagaagcttggtagggtaaaggaacccatggggcagcctgtcccaggttcccaacttgtcaccttgggcagtcaggcgaaagcacaaaaataggctccagtgatggctggcacctccttaggctcacttagattcctacagtagggatccaatgcgtgactgcagcctccaaccagtctctgaagaatggagagaacagggaccagagagggaaggtgatttccccgggtcacacagccagcagtggctgggctggacccagatcccacatctcttaactctggccagtggtgcctcccctaaaccacagttgttgtctttctggaaggcagaatgaggggtccagaaagatcccaggagacactcagagacacacaagttaggagacagactggagagataggaactcgaaaccttccccactcccagccatgcttgtcctcacactcaaagaaccacaggaaccagacagcagcctccatcctggctctgcatctgggaaccatggttacggctgctgcttgattggcagggggtccagacacattcgagctaccccttgattcctagaggttgtgtgagaagcaggagcaagggccaggagagaagctgggggtcaccagcaggccccaaataccaccctctaacctttccctcccaagccaatcatccaggcacctcgcactgccacgaaatcctttttagagctctgaattaaaaataaatttgcaagcacataaccagatgttacatggggaaaagataaataactcagcctgtcaaggaactgcctcatctcagtcaaccctctctctttcacaaggttttaatttttaatttcacagcggtaactatagcaacctgcaaaaataatatattccaaagcaaaacaactttcttggctctggcttggcatctccatgttccctccttccctcctctccaccaacttcacgcaggtctgtgcccagagttgatgaacgctctcagctttgaatgccctcattcattaagtaattaattcattcatacacaagtatctcttgccatccaaatccatagaactcctaaattcaggtagcgggtattggacaatggactcagaatcatgtgggatgccatgttgtcttaacctattttgtttctaggttttgagtacataggaaaatttggatagcaagggacatctgtattcattggggacctaatttgtcccagagtcagtgctaggcaggccctggggtgagagagaataggactgatcctgcccttaaggagctcacagtcctgttggggagacagaatacaaacacataattacaataaagtaatataagtattgtatacaagggaaaaataatatacaaatggggcacaaaagaagggagaggctgtcaatatctaggatgatctaggtaggcttcacagagaaggtgacttctgagatgggtcttgctggatgagtagaagttttctgaatgaccagcatagggaagggcacatcaggcaggtggaacagcacgtgcaaaggcagaaacagatgacataggtcagtatggcctaagcataggatgagtcatacttcaaaaagatactggagaggttgacaagggagaaacatacagagccttgaatgctgggctgacttcagcttggaggccaggggaaatcagccacatagggagtagggcaaaacataaaaggccactctgaggacaagtgtggccaatggattagagggcaaagaatgcagacgaagcctgtgggggaattcaggtgggtggtggctgcagggaagaaaagagtgaaaaagtgtcggtttgggttccctaagaagcaaaccttgagccaaggatccaatcttatttgagatgtgaccccaggaagcactgatatggggaggagggagagggaagtgagacagggaagggaagaaggctcataaagtgtttattagaaagccagttagcaccgtgggccacgggagctcagtcctcctgggagttctgcgagacggcaccgagagtgcctcagagttgcccacttcaagggtaggaggctggaggatctcaatgccaattcctagagtaattggttggaggctactcccaggaggcatcaattcctggtgagcagggtccagtgccagataaaccctcaagcagagactcatgtgccagcagccagacacagggcccatgtgtcctgaaacagaaaagaaatgccaaggggactcaggtggggcattaagagcatctgcccctgtggaattctgaaagatagtcagtgggcatactgggagactccaacatctggcagagaggcagacgcactgacacacacagctgggacaggtgggtcatgggcaacagggcccaagtgaggacagacccatcaccatcctgtgcccaggctgcttaagggtcccagtgggatgctgtggctcctgctgcaaggaggctgagggaggaggatcacttaaggccaggagtttgaggttgcagtaagctaagatcccaccactgcactccagcctgggtgacagagcaaaaccttgtcttaagaaaaattaagaaaaaaaaaaagaatcccaatggggctcaaaggctgggtgacagtcctcagcacatccccctctcataatgggatagaccttctttccaaataaagagtcctctctcaagtaaacagagcttccctctatccctgattaaaactggaaagtggcaagaagaaaatgtgtcaagtaggaagatgcacatacaggatgtgttcatgcagggatataacattgatggtgaccttgtgtgagctacttcacctcccctggcctcagtttcctcttctacaaggtatggttcatagaggtgcccattgcattatcttgtaagaatgtaattcgatgatgcatggtgatgcctagaagtcacctaatcaatattacctgtgaatatcgttcttttctgcaatattgttttttagcatggtccacatgggaggccctggggagacagcaatcatcaagcagacttggttcctgccctcgtgctgcctccagccttgtggacatgctgaaatgctttatatagaatgttaaagagagccagataaaaaattatgcatagagcaagattctaattttgtttaaacacacacactcacaaaggcccaagggatatacaccaacatgtaatgatagttaacaccagatgatggaattgaaggtggcttgcagttttacaattctttcctggcttttttttccttttaaaattttcacagtggattgtattattcgaatagtcatttttgaaaaaataaaggaaaacaagaatgcttctttctctgactctctgcccatcacaaatttcatctgtttcctcgggaaccaggagctcctggcattaggggctgtttgcttgtacattccagggtctacccaccaggcagccaggtctcaggtcctggcctcattccctactgtggtgcacatttgaaaaggggctgggggttggggtggcctccatcagagcaacaaacctggactgaatgattggtgagtatgaagaggggagccctctctcaacctgggatcagctacctgtgaagacatgttctgtcccaggagtcagaggggagaggtctgtgtttatccatctacctgtgattgcaaaggtaaggctgtccaactctgaggatcagtgttagcagttccatttgcctgcatgcccaagccacgttctctaaacagctttatctgtaataagctgacattttgttcctcacctcttgactcctcggtctcctactgcttctgaacttaagtgaggaagaaagcaacattatatgtagatgccataaaaatcacatagtccatacctggctcctagaaattggctattaacaaagagattagacacctatttttctcaagtttcctcttttttccttttgacaccttgcttttctcttttccttttgacacctaggactgtgagatagacccaatgttcttggaaagatctagtaatctctcctgtagcgaacttgacggtattgtctgtctgagtccctttttcggaaaatggtccctcctccacaccatgtaaacttggggtttccatcaagatcaccaaaacaagagtggtcatgggtcccattcaggaccaaagtgattttctgggatgagtatgtggcatagatatggatacataatatatgtaggtatatgacatgtatatgatagatatatatacatggatgtatgatgtgtatagaggatatatgacatatatatgatatatataggatatacaatatatgacatatgtgatatgtacatggatatatgatatatagagaggatacatgatatatgacatacatattatagatgtacacagataaatgatacatatgcctcgctcctgccagccttgctgggcttgttgcatacatgtttgggtgtacctgctggtggcctgcttccctaccacacattgacagcctgcctggaggctaaagccaaccagaaaagatgaccctgttgagttcctgtatccagccattcctgaaaccaccttcctagaccagaaccaatacattccctcttttccttaagtagtttgagttgggtttttatcagttgaagctaaaagaatcctgactagcatactgcagtgaatatataccggttagaaggctgtgaccacccagaatccatgcccccttcctaagtaaccctcattgtttaggaaaatcacctctcctccattgaattcacctgggggaactgctgggcatgacactgctccttccttcactcctaggtcactacctacacccccacacaagaccaggtgaattggccatgaatcccttccaggcctgcccataaaacctcccccatgctcctccacaccctgtcttttcctctcctctgccgggggatgcagaagatcaaaaaagaaatcaagatcccctcccctggatggaaggacctgggtctctgagtgaccatgaggagttgacctacactggactgtgacctgagtgacaagtaaacagattatgagtcactgagatttgggggttgtctgtaacagcagttatcctgccctaactaacacaataggctggcacattggagagctacctgagagccattatcctaagagctttccattcaaccacgaatatttactgagtccctattctgtgcttgcaaagccccctgtgtttcctgttctcctgcactgcccacgattgcctctctcctcgtctggctgtcttctctctctagacggtaagttccccaagagatgggtccttatctgtcttcatcctctgcaccgtgtccctggtatctagtttagcatcaggaacatagcaagtgctccgtattgattgattggatttgcaaaatgaccagatgcataaagttgtcatgaggcttaagcgaggttctgattgtgaagcgtcatggcacacaggaggtcccctgcaaatacagtaaaaatgagctaaatcaaggtgcatgtgggctgggcaaggctttcagtgggagggcagattttagccaggacttatcctgccctataccctacagagagctaagttatctctggtcctggctggtcccaggctctatgcaggaggaaggatggggaccagctgcttcctggagggagccccagtcccagaggctttgagctgtggtaggggtgaggcaacacttcaggaaataacatttcaaaggctttggctgtgagagcagacttctcacccctgtcttgtgtggaggtgggtgtgggatgcctggtgtgcctctggggtaaagcatccctttcacggtttgaaatctcatctcgggaaagcttaactccttgtaccccattctactggctatagacaggctccagggatttagcccaagactcctaggataatgtccaaactccatacctggggtaggaatgggggcaggtgcagcatgtccagcatgatgcagcagttaacagcctgggctctggaggcagaatgcctgggttcaaatcctggctcagttcacatggtagctgtgagactttggatgactcagcttatctggacctcagttttctcatctgtaaaatgggattataatagtaacacactagaagattgttaggaagatgacctcgctttgacaactaatggagtgttcttttcttttcttttcttttctttctttctttctctttctttctttctttctttctttctctttctttctttctttctttctttctttctttctttctttcctcctttcctttccttcctttcctttctttcttcttcttttttcttttttatttcagatctcactctgtgcccaggctgaagtgcagtggtgtgatatcagctcactgcaacctctgcctcccagattcaagcagttctcctgcctcatcctcccaagtagctgggactaccagtgcgcaccaccacacccagctagtttttgtattttttttagtagagatggggtttcaccatgttggccaggctggtctcgaactcctgacctcaagtgatctgcctgcctcagccttctgaagtgatgggattataggcatgagtcaccacacctggccaagtgtgtttcttaaatgttttaattcctaacatggtaactatcaatagataaactgacataaacaaaattctttggggtccacagtaatttttaagagtataaaggggtcctaaaaccaaaacattaaaatccagtctcatgtgataacttcacactacacatgccagatgattcacctggcgtcaattcttcacttcctcctctcctcccccgaccggccatgacctagtttggaccctgtgctctgtccaaatgagcaactgaggcacctacccaaggaggccatgaggattcctccctccacacccctgaacagcagctgtctaccctgaattctgtggtttcactatccttaacgaaattgtacttactctgcaaggcccaggggcttctgcctcctgcaggaagcctggctgactgccctaaatggagcccttggtcctctgagctcacacagcactgcccagtcatgagggcagatggccaaggcagcttcatcagttttgcttgtgaaagcccatcttctcactagactgcacgctgcctctggctttggggtcagaacagagctgaactgggtcatgttgggcaagtcgctgtccctctctgagcctgtttccttatctgcagaatggggtaattatgagacttactgtgcagatcttgtaaggactggatgagcaaatgcactggattaatttgctagcgctgccataacgaagtatcacactcgaccagccgctgtggctcatgactgtaatcccagcactttgggagactgaggcgggtagatcacttgaggtcaggaattcaagactagcctggccaacatggtgaaatctcctctctactaaaaatacaaaaattagcagggcatggtggcgggtgcctgtaatcccagctacttgggaggttgaggcagaagaatggcttgaacccaagaggtggaggttgcagtgagccaagatcatgccactgcactccagcctgggagacagagtgagactccaactcaaaacacaaacaaaaacaaacaaacaaaaaacgaagtgtcacaattggctgtgatactggtgcttcaaaagaaaccaaccctgctgaccccttgatcatgaacttctagcccccagaattgtgagacaataaatttctgttgttttgtgccatgatgcttcacaattaaaacctcacttaagcatcacaatgactttgtacatctggtcattttgcaaatccaatcaatcaatacttattgagcacttgctgtgtttctgacactacactagatactggagacacagtatagaagacagacaagcacccgtctcccagggaacttatggtctagagagagaagatagggcagggccttgggggtcactctaaggactttcgcttttcctctgcacacaatgcggagccacaggatattctggtgcttcaacaacagaagtttattgtctcacaattctgggggctagaagtccaagatcaaggtgttggcagggctggtttcttctgaggcctctctcctcggcttgtagatggctgtttctttctgtgtctttacctggtcttccctctgtgtgtgtctgcatcctaatctcctcttcttataaagttgtccttataaaggacaccagtcatactgaattaagatccaccctcaatgacctcatgtaattaattacctttttaaagacccaatctccaaatacagtcacatgctaaggtgttgggggttggggcttcaacatatgaatttggtgcgggtgggagaagacataattcaacttatatggcatctaaaacattctgcctagggctgtcaggtgtaagtaagctgtgcttctctctccactgccaccagagcctggggctgcggtcagtggcttgggctgggcctttagagcctgaataaatcggtcatcagatatgagctgcccagggaggggacatgacctcaggcaagactgctctccttaactgggcaatctccaacagggactttgctgcaccaccaatagctgggcagtaagtccttctttcctgaggagagctgggcacccaccctgcccctttactcgctacatgaccatgggtaagctccttgctttctctgagcctcaacttccaaaactggaaaaaaaataaaatgacttgcagagggatgatgatgagatggggtcattgctggtatttttatttaggcaacaatttattttattgagcacctagtatgtgccaggcattgttctaggctctggggatatagcagtgaataacatggacaaaatctcagttaaagctgacgtcattacagggactgccaggcactaaacaaataagcaagtaaaatacatagcatgtcagatgctgataagtgctgtgaaaaagtagcaattaaaccaagaaaggggaagcgagagtgtgagaggcaggggtgcggaaagggggatgtcacaattttaaataagatggtcagggaaggcctgtctatgaaaagatttggcaaggtaagggggccctctagatatctccgagcagagctttgcaggcagaagggccgtgagcatccctgacgtggttcctgaatgcacggcctgagctcagtgagcaaaggggacctagactggacatgaggtcagaggagtggccggggtcagccagggcagggcctggcaggccactgtcagaacttcggcttttcctccacatgcaacgtggagccacaggagtcttctgagtgcaggagggggcgtgacctcactttgattttactaacacagggtaacccaggtgacaagctgagattgcagccggctcccctgctcccaccttccagccccgctgggccccacctagtaagccctgcccaagccgccaccccctctccacacacacacacacacgcgctccatcagtcccacgcctgcttgtccgtcaagtctcagtctagccctcacctcctcctttgggaagccagcccagagcccctgacctgcctcatccctccctccccagagaaccaggaggcagttaggggacaggccttggcaatcaagcgccagattcaaatcctccctacttagaatctctgaacctcagttttcttcatctgtaaaatggagataataataacagaccattaaaaacccaccctcaggtagtaagtgaaatccgaaggttcaattgtataaactacaccacagtaccatcacagggtcaatgaacagcagcattatcagctgctctgtgttgtcctgagagcaaagacataaagctcacaccgcccaccactacctgagaaaggtccaatggtcacagggcttgtttcctaacctccccccaaccccagtcaacccaagaccacccacacttgagaacaggggctggaccaaggctggctgctcatcaccacccaagctatgttcaccacgtgaccacagggctgtggcatggagtgatgagacatccttgggtgtgtgcctggcacattgcatgagtgtcacctgctgctgctgctgcacccatcacgccatgtaggaggatctccttcctcttacgctgcctccagcctatgagaggatgtaggtaatgactatgctcacaaatatcacaaatgctcggtatacagcaggggctcaataaatgcttgttagaggcaaccagagcacagccagatgtgtgcgtgtgtatgtgctgactgtaccattttccagatgtgtgtcccacagcccatcactttgcctctctgagcctctgttacctcatctgtaaaatgggaggactcattcttgcctggaagggtgagtggggcatccccagggctcctgcgccccagtcacagggtgaaggtatggcaccaatgtacccagaggatatctggcaggtgcacagtagacataatagtccacataatagtgacaaccagagccaccgtagcatctggcagagcagacttgggagtgagctcttgtgagtcacaggttggggcttccctgtgtaacctggtgaggctcacaggagtccaatggcttagagtggcagatagggccatgagtcgggccattgtctctgtgtcatcaatgattctgtgtttggtaggtttgctctagactcagagaagagcaagactcactgggagcctcttcccctctgctaagttttgaatgtatcccccagagttcacatattggacatgtaatccccagtgcaagagtggtgacatgtaggacctttaaggaatgattaatgccattatcatgggagtgggttggttatcgtgggattgggttcttggtaaaaggatgagctcagcacccttccctcttgttctctcttgcacaatctcttacccttttgccttccactatgggatgatgcagcccaagggccctctccagatgccagctccatgctcttggacttcccagtctctagaatcatagccagataaatttctattcattataaattacccagtctgcagcatcctgttatagcagcataacatggactaagacaccatcctttgccccagttcagggcaaagaggcctcaagaaacccaccatttgtgagaaacttttatgtgcttcctggactttctaggtatttactgacagctaactgttacggagcacttctagcactaggtactgctctgcgctcttgtaccgtctcagacaaggccccacaggaactccttgacacaggtattgttatcaccattttgcaggtgaggcaactgaggcacagaaagcttcccagagtcacacaggtagggcgatggagaaaaatttggagtctaagtctgagtccctgagctttctgcttaggaggcagcctagcctggtggttaaagctgtgaccccttccaaagccaggccaccaggggtcaaagctaggctcttcccctttgttctccttgcctcagtttccttatccagaaaatgggagcaataggacctacctcatcagactgctgtgaggattaagtgagggctgtgtttacagtgataggcaatccataatccataaaagtacacgctggtcctaccagattcctccttctcttagctcagaggacttctcccaatgtgtctctctgtcagtcttatttctctctcttgctctttgccatctcttctgaggcatataagcttctctttgtcactttcctctctatcttggtcccttctgggtcctaaatcctggctctgagtttatgtgctgcataaacttcagcatagcacagggcaaccctcctgactgtggatactctcaaacttcatagaaatttctcctggggaactggctaaatgcagagtcctggttccaccggagagaatcagattctataggtccaggatggggtgagagaatctgcattttaaccactgtcctctccaaaacctttcaccctgtgacctcccaggctggctcttgaactatactttgagaagcactgcatttgccctcagtttcctcatctgtcaatttggagtaaacagaaactacctcccaaggttgtaaagatgaaatgaaataatttgtctggaaagcaaacaccttttctctgtcttggcttttgtaaaatttattttgtctctgactttcccattctctgtttctggtgtttttcctatttcattctctgtcctctctctccctaccctctacctggaagtggacccaactccagagctgaaatggaaaacactgaacaggtgtggcccttctgtaaaggctggaggccccaagatcatccaaatggcctgtccagctccttcctactggcaccccagcagtccccaagaccaagcatccccacccctgcagcccccacagcagcaaagctggggaaagatggggatccattgtgcaggaacggccttgctgctatggaaaccagcactcagaaaatgctcagagatgatccattctggggagcggcctggccttgggggagggggaaaggccaaactctgcaccttggactttgccctcccattaccggccatgtgatgctgggcaagtcacttaacctctctgaaccctcctctccctcaccgggccccgagcagcagcctccattatcggtgggtgataaccgccgctgatgactgaacactgctctgcggctttcaagcctgaagacacgccaaattgccatttgctttcattactgcgagcttgaaatattctagtgccagcttgctgcatgaccctgtgcctccgagggccaccaaactatttccatgatagaattccctctcgcagaggtgcagagtccactctgagtcactctacaacacacacacacacacacaccacacaagcacacacacaccgcacacacagacactagctactgagctaagttgcccatacacttgcctcaccccggttgcgctgcgattcctcttctaggaagggaagaagtgagcacaatgtctcctgattactccatcagcagcgcccaatgctctgcagctgcagaacttatctcatggtgcattttccttcctcaatgtctcccagggcacctcccctccaagatccctcccacggttccccatgcctccaggcctaagtctaagctcaacagcctgaccttcgaggccctcagagccaactgcgcccttgctccacaatgtcacccctctatttgcgacagcagtccctgtgaaggcagggattctgtttgccattgtagctgatggaaccccagtgcctggtacatcctgaggccaggggagcagaggataagggcatgcatgagagggtggctaccacgtgccacccaccccagggacatcaagtaagacccttaccctccttgtgcctcagcttctcactcttcacaacacacagtaacacaccacacacatatacactctgaaactcacacacacacagcaacataaacacacatcccacactcccccatacacagacacgcacaccatggtgtacgaagagcatcggaccccctggccatctggccgtcccctgaacaagctgtgcactttcctccctccttacctttgctcatgcagtttcttcttccaaaaacccacttccaacaagttcttccagagctctcagggatcctctgcacgcaactcctcctcagtaatcaatgtaatttctcagagaacacgatgacttgcccaagatcacacaagaagtgtgtggccgcagagcctgtgtcagaacccaggccttggggtggggggacactgagtccagctgctctgaagagcatccgagcatttattcagccagccaggcgcctgtttgtttgttttcccaacacacacttattacgccccaggcaggctgctcagtgctggggacccagccatgaacaaggccagcacacgcagcccagagaagcagacagatgctaaacaagtaattacaagtgtgatggatgccacaaaggaaaagcagcaagggccctgggaagagacagtgggggatgccaacatctcccatttgtacaaggtttgcagaaaccttaccgcagtggtggtcctgcagcacctcccatcagaatcccgtttaaagcccccaggcatgcagacccagcacttctggggagggctgtttcttcccagggaaggacactgtgaggtttgaggaccacagctttagaggcctgggtgagggggtctgaaggtggtaaatgttttctaagtatccaccagatctcgggctgattcactcctgccaggccactgaggtaggcagcattaggcccattttacagagaagcaaaccaaggcctagaaaaccccagtgattagtgagtatagaagagggattcgaacccaggcctgtcagactccagatctcaggaaggtccttaaagatggcccggctcctgggtgcccagcacacaaccttgccaaatgggcttacagttaaaagggaaaccactagcactcagagaccccaggtcacggattacaaggtgccacttgtgctttacaacagagcatgttagtcacatggtgctaagtggctctgacatcacagtgggcatccagccaggtacctccactgaccaggtgcatggcctcgggcaagttgcttaacctctctgggctcagtttcctgtctgtaagatgggacaatggtggtggggaggagtttctctgcttaggcctccttgcctcccctccccctctccctccgtctgctccagtcacacccgcctcccagcctttctcaaacatgtcaggccctgtccctgctcagcagctttgcacatgctgttccttctgcctgaacactcttcctccacatagctacatatctccgctcatatgtcaccttttcagagagaccttccccgaccccttggcagaaatcacccccacaccacccctgtgtgtccaccaccctgtatccagccccgtgtccatcccccgtgtccatccccgtgtccatccccccgtgtccatccccctgtgtccatcccctgtatccatcccctgtgtccatcccctgtatccacccccctgtatccacccccctgtatccatcccccctgtgtccatccccctgtgtccatccccgtgtccatcccccctgtatccatccccctgtatccatccccactttatttttctcccccgcactgtcacagctttgacccccacctccccacgtgagaaagtaagttgcaggagggtagaggctttgttttgtcagttgtttccccagccaaggctcttgactagggccaaccagagttaacaagcatgcaagggctcaatctagccagggcttctgcattaccatggcctgtgaggcccctggcagcccattggagaggtctctaaggcatctgggaggctggttctaagtatcccgcccctagcctggtacacagcgggcatcatcagaacatgtctgaggctgtgctgacctgctgtctgagagcagacactgcccgggcttcctggaccacagcaaagacgctgaagagaggggcaatgaattcccctgggccccctccccaaatggccctgaaactagcaggcagtgggaaaccagccccaggcttggcaggggcctggcagaggctcagtgccgagggccaagggcctgccaacctcactcccccaaacagcgaccaattgtcccagcggcgcccaagttccctgaagacctcccagcagtcactctctcacagagacacccgctctcaaaggggccagcagtctggctgcttccggccacgaccacaaccaaggaggctggaccagcatggtggtcccagcttcacaggaggccccgggacttccgagccctgctgggaacttgcagccgggtgcttggtgaggagcgggtgaggacagatcccgggggtgggccagtcctcttggcatttgtatgcaggtgcagacccatgaacatgagctggaatctatcaacagaaaataaaacactcagggacagaagcctcagaagacaaactgctgcggggcgaaggtggcagccactcctgcttgctgggtgtgcaacatgtctcaggcccactctggataggcattcatccaaccctcagacagggagatgggaactgtggaacctctgtgtctcagaaaaggaaatgagggaagccatttgcccagaagagggaagccgggatttgaacccaggtctcctggcaaggccttgaccactatgctacatcctaaacctcccttgatggcgatgaggaggggctggtcaccaggagtcacgttcccatgacaaagtctcattggtgccccccagagcaatgggtctgagccctgctgcaaaccacctgtgtcagaatgggatgcaggcagcttcctagaaagcccattcagacctgctgtggctacatttttcacatgatgctactggattctgaagcgcacactggagtttaagaaccactggcttagaggcaattctgacctagacagaactagcgctttatttgtcaggacgatagacctcgagaagagctgcctatgtgggatctggaggtgacaataaaaacggctgttgattggtcactgagtatgtgctcggtcctcttttaagtgcttcattctcatttcatccttagcacaactctacagaagaagtaacagtattatcttccccattttagagatgagaaaactgaggcacagggagcttaagtctgtcctgccatcctgtgagattcatgtagttgtttggaggaggtccaccttccatctgggtgatcccagcacctgctaggtgccctgtacatgcctgcgtacatgccctgtacatgcctgcagcactgaatatgaactaggccaggtgtgttttggtggtgcgggggtcccaggacagagcttcccaaggggcaagctttgggaactctcctgacccaactgcacccccctacacacatccaccttcctgggcatacagtcctacttaccctggtgtggctgagcaaggtgctacccccttcgtcttctttgtctataagtagaactcctactatggagctattagagaaatcgggtctaaatggagccactcagacaaagcccttaggaagtggataggagaggggtcaagttttaggatgtgggtgtgaaacccacctggatccaccacttgagcgctacacagacttgcctgagcctttcatcctcacatctgcctagtgaggatcagaattgtatgtaatcacgtgaaggtgaaatatgcaaactacctgtgcacagtgggcctcactgtacggtcgccggtgaaaagtactaagattggtgccacaaccccatcagcacaacacccctgacccctccttccagggctcgagctagggggttgtcagtgcctggctggtgctcaggcctcttcagctggagcctggagctgaaggcctgtttgctgggttacaggaagatctgagctgtacagctggtgctggcgaggaaaggtatttgcatcagataataggtaaagtgtcttgttattccattaacttgtgtagcaacgactgcggcagagggagggagcgttggaaagccgtagggtgggcaggggatgagctcactgacccacagctaagccagggacttccagggggcccagcagcctcaacaggagctacaggggtagcctttgggcagaggggtatgggtgaggctgcccctcgttccagaaccctaaccttaaggtagggccccagctgggggcaaaatcgaaaagtacatcccaggcaccaccagcaccagtgcctccccctcccccacccctaattgacctctgagtccctggggctcaggggctctgaccatgaccacagcatgcagcctcctgaacaaaagcatagatgctggagccccctggatgggggtttgaatcccgactccacccttcacaagtttggtaagttgcacaggcacctagcattgctgggcttcctattaaatgggatactactattacactcatccctcgaggccatgtcatccctcctctgacaaatcccatggagtccctgccacgtgctggtgccttctaggcactgggaaccagcagggaacaacagggactaagtcttgttctgacgaaatttgcattccaggtgggggagggtgcacataaataaataagagaaatatgagaaagtgataagtgctataaaacttggaaatgggataacaaggggccagatgtaaggaggagcggtcttttagagaatgaaggaaggatactctggggggaggcatttgaactaaggcgcaggtgacatcaacagccttgaagggccccaggttggcctcaagggacacgtttgaggagaggaaggaggccagtgtggctgaagcagagtgggcagcaaagatggacaacctcaggatggagaagagtggggactggccacgtagagcagcatggctgcaggattcattttgactggaagcaccatggcagtccctggaggttcagagcaggggagggatgtgatctgattttgatggttcaaaggcctcctggctgctggtaggggatggattgcagaggccagggtggtgcaggggagctgaaaagaggctggtacagccatgggcatgacagcagctgtggtctaagaaggtagtgcaggggaatgtgggacgagacagtggaccagggctgggctgggttttaaagatactgtcacaggatctgaggatgatgagcaggagagggaaagggaagggacaaggatggcacaggtgattgagaccatgtatgttagcagagggtttattgagcgtggccccttgcatacagtaagtgctggtaaacactgcccattgggaaagcatagtgttctacactaagcaccaccttctacaggaaccagccctgttgatcaacagagcggcatttctggtctcagattcctggattgcaccaaatgacctctgaggggataacagaggactccacgcaggaagggttcaggcagtcatgttgcccaacatgtgcggtgacagcataaacaccagggtgacttgtcccaggtcactgggcttgttaggggcagagtgggatctcttgaccctgtaaaatgtcctctgggatctaaagtctgagattcccaggtgtgagtccttctctggacctcgggcttcggtagcagagtccagcctcagagcctttgtgcttgctgttccccttcctggagcctcccatgacctttggatgtcacttggcctctctgcgccctctcaccccagcagttctgcagaggtcagcctttagaactgacccacgcctccctgggcctgcagggtttcacagagctcggcagcagcttgggttacccctagggtcaggtcatcaccatttgcctcatctccttccacagccaacttggaaggattccccagccttgtgccaggagaggctggcacggctgccagagccccactccgtggcgccataggccctcacagggactgccctggctcctggtggccaaaccacacaggatagaaccacctttcctgctgggacacagcccaggcggaatccccctttctttctcctggaccaatcagatgtgagtcagggaccctctcattaacaaatttcctcccttcctcctcccctgttatgaggccaggagcgggcgtcgacctacatggaaggggaggagaggtggaaccagttggagcaaatacccaacctgcctcttgcctggtaaggtcacccagaagccttgagccagcagccgttccttcctccatctccaacggtctggccttatgctagcccccaactcaggacacagactttacacttaaccccaaagcagtccctgcctcacttggggccaagttcagacaagaggcaatcagggacttaactggctgccagagaaggccacccgcctggttattaaatattaagtggcaagagcctgagaatgtataattgcaaatgagactctgaggcagatgttgccaacagcttggaccggtgcatgcagttgggaccaacaggggatttcaagtcaccaagccaggctgctggcaagggccccacatttgctgggcacctgctgggtaccaggccctgaactggatgctacgtgtaaaaagattaaccagacacgactccagcttcaagaggttccctgtccgctgaagaagtaagcaagggctcacaaccacaggtaatctcgggcgtggtgcgggccccagggaaatatctagaaggggttggagaattgaggcttcagagtggaaatgagctgactttgaactgtacattcagtcagtcatttaacaaacattggttcaatacctaatgtgtgccaaatgttgtagattcagggaaataaagtattaaataaaccaaactctctcatggtgcttacaattgagtgagagcttgtattccaaggatgaacaaggtttgcaccaagaagaagagataaagaagagagcgagcctgtgcaaacattcagaggcatgaagtcaagtagcttcaaggtgaatagggagttcactgcggctggacatgtgtgaaagggagggagtgaggcagggagcaagggagggagggagggagggatgggatggctagtagccagagcctgaaaagctgccacattaaagagtataggtgagtcctggagggtttcaaagtacagtgcaatgccctccctcagggatagtccatggctcccaggattcctgagataggacacagtctactctcttttttttttttttttttttttgagatgaagtctcgctcttgtcccccaggctggagtgcaatagcgtgatcttggctcactgcaacctctgcctcccgggttcaagcgattctcctgcctcagcctcctgattagctgggattataggattacaggtatgcgccaccaagcccagctaatttttgtatttttagtagagacagggtttcaccatgttggccaggctggtcttgaactcctgacctcaggtgatccacccacttgggcctcccaaagtgctgggattacaggcgtgagccaccgtgcccgaccggatatagtctactcttttaagcagtaagaggaagcaataagaggaagaagacaccccactgaatatcctggggcatgagtgtggttgcctggttagctacccacccccaccccaggctaggttactgagactccaccgagggaggatctcagagaaacagagccctgcccctttactctccccacacctgcagcctgtgtcagctcctgaactgctaagaacatatcctaggaacataggtgcctttgtcttcgccaggaactcagtccctgtggcaggtggcggtggggagagtaatatgagaccccagacccttcaggcaacaagtccttgtccagcaagagagccagggaagattccagtgcaacacttccaagaatgtcctcactggctggacctctgtctccactgccctgcccggagccagggtggggtggactggatgaactttcaaggtcattttctggccatgattctatacaaagagaagggggacaagaagaactgcatgtgcatgtgaagatgctaaaatcccaggaggattagggtccttgaagaggttctacgcgtctagagttgcattcggctgagattctagaattctatagttcgacaattccaagattttagaatcctgtgattctaagactcttacttgattaggggaaggaagacatcgtagtcatcacatccccttaataaaattcacgcctctgggaagaaccccacacccgtaactccaaagccaagcaggcttgttttccccctttctgcctttaaattgtcttttcactctttggtgtctgctcatctgcacacccccctccacagtccctcctccaagcctggcagccacacatttgccatctacatataacccagtgattagcacagcagaacagagaggagggtgtggaagccatgctgcctgccagtcggacggccttaagtcgaccaggctgcagcgaatcacctcagctccctgaaagggctgagcagggaagggaaacgcactcctgcagattcagacacacacacagagacacacaaaggagggccccaggcacacagacacacaaagaaacagagatgtgcacgcacacacagacagtgcaaacagcacacgcccacatgcgtacagcactcacacacatgcaaacaaaccagagacagacacacaaccccacagtgacatacacctggacacgcaggcatgcagaaaaacagagaaagacatgcacagcacacgtggatatttgcggtgcaacatagacatacacacacactcatatatagccacacagcaaaacacacaatgcatgcatacacactcaaatgtacaaacccatgcaaataaatccaaacgaatagatacggatccagagttacacagatcaacacactcccagggggacaacagcactcagctgttaacatacctccaaatgagagttgtcagaatcccccttctcatccccatctcccactccctctcattcatgggacattatttaggcccactctgcacacaacctggcactgggcccctgggagatcccagggctctgacacagtggagtaaggggaggagcagttcagtcagcccccgggaactcagaggcagctagaatacagataggcactgggttcaggaaaccattcccagagctgtacaaaatggattgcctggaaaggtagtgagctccccacccctggaggcaatctagtgcaaccaagggttttgggcatcagatgggagagtgggtgccaggggaattgaaggcctttaaaatctattccagccctgagagtctatttctatcaattccactgggcttcaaaacagtggtcttcaaaattttttgtatcatattccctatcagtaaaaacatttaaaacatgtattcctcaatgtatgtacatttgatactttttacaaatttttgtatatttctttgttatgtacttcatagaacacatacacaaaatagaaaaatttgaaaaatgagataaaggtacatagatcactactttaaaggacaggtgaaactgaagggaaagtgatataacatttatgaagtccctcctgtgtgccagacttttgatatatattatgcctttgaatcttcaaatagctctgtaaagaagctgtcatgagttttccattttgcagatgagaaactaaatggcaagacaaataaaatcatttccccacagtcttgccacctgtagctgccacggctggaatctggacccaagtaagctggctccggagcccactgcccaccctgaccactcctatgtcatacaggaagcatggagctggggaaagacccatttggtttttgggggcaacaggctgagtggaggggctgcacgatttgtcaagagccctgaatgacggccttgaagccaagcagcaggtatgattctcaaaccacaggcacagttgggccagatgtggccatttctttcctttaaatcttcactgctcagagtgcagtccagggaccagcagcttcaacctcacctggaagtttatcagaaatgcagaatcttggccccgctacaaacctactaagtcagaatctgcatttagcaagaataaagtttgagaagcctcaaattacttaaactcatctggtctgtgaatgtatcccatgggggtgacgtgaagcaagcccaaccttggtcattcttggggctctctcctctccagagcctgctcagatgcagggtcttagagagtctctggacatttgaggtggcttccaggaatctgtccacactgcttgcctgcagctcctcggctcctaatcccgcagtggctcccatctggttctgagtaaaagctgaaggcctcaccttggcctgcacggcccaacagactggaccctgcttcctctctaacctcatctcccgcctcactcctggctagtttcccgttgcctggctgcccagctgcccttgaacttgtcatcccagggtcttcccggggtctttgcactggccattcctttcacctggtgttcctatggctctccttcatactttccttaggaaactccactccctgagtgagacctccactgcatagaatagcatcccctcccccctaattcatacatttatctttccatctcctccactagaatgtgaatgccttgagtgcaggaactgtgactatctcatttccagcatccagctgagcccctggccatagtagatgctcaataaatatctgttggctgatggaggccgtgcccattgtcccaccctaagggacacccatctcagtcaccctgtggggctgtggggtcttccatgagggcagaggtcttgagacacagttatggctacctggagccaccgtgaggcctgccctggaggccttgtcccctccccaatcctgctggcgtgggggcagcaccccctgtcagcctgaccccctccagcttctccagtgtgcttgcccccaatctctcccagtctttcctgggaatctctttggttttagactttactaaagactaaggggagttcatttttctgcctaaatccctgcagtgcctgtttactaagcccaactatttgcttgaagctgaagagaagaaacataaagaggaaaaacagactaacattttctaacttggcctgtcatgcctacaggccgtgagagctcaggccacccatttccctttctgcgcctcagtctcctcatctattcccagagattcatggggatagttaccaccttttttgctgaagagggaatgagacacagtgagaaagaaaactataatggtggaatttcaagtatgaaccagccagggttgtaggcgttggggcagcagggtgtgagttgggagtaaggagggggactaagggatttgctatcaaaagatctgggtttatggcctttctgtgccactaagtcaatatgttggtcaggtagagcctctgtttactcatctgtacaataggtatggcacggctatgaggctcccatcagatacagtccaaagggctctgggagacttcccaatccacttccctccttgctccagcagcagtggcagcatgaaggctggtgtggccaactgctacccagagggcatggtcccaatcggaagctgcagcagcaaagacagtggtatgtgttgtttaggctttccctgagagccaaaccagttcctgcccagggatggacacttcctttctcgggtacaggaatgaggccaactagagtcttggcttccctgcccaggaaagcagccgggggagtccaacgaggacacctgttccttcaggaaacccaagccaagccaggccctcgggtggcggagcctgagcccctggatccagctgccagtgccctcatggacagagctgcatcctgcttcctgtttcctgcttcctgctccttctttcactctatcagtagtttctgcctgaggccctactctgtgtgggctcagctccaggtgctagggaacaaaggcaaagagctcacatggagctcaaagatcagtaggagagccacgcaaccaatcaaatgtataacattgatatgctgtcaagaaatggaaatgctatcaaaaaataaagtggagtagggaataggaagtgatgggacagttttagctgagtggtcaggacatgcttctctgcagaggtgatatttgagcatagaccctaaggaagagtcaggggcaaactaggcagctagctggggaagagggttcttggcacagggaacagcccgtgcaaaggccctgaggtaggcacctgctgggcatgttcaaggaatactgagatggtgaattaactggagtggagtgagcaagggggagagtgtggggagaccgggtcagtgaagcaggggatcacagggggccttttgagctgcactgagaacttcaggttttactccaagagaaggagtggaaggccattgggaggcttttattgaagaagcaacaaggtggggagtccaggaagtacggagccagtgaggaagtgactgcactaatccaggtgagaaatgaaggtactgggaccggagtgtgatgcaggtgggaaggagtggttggattctgggtttattttgaaggtagagccaagaggattggctggcagggaaggaagagaaagagataagtcaaggagggcaccaaggtattttgcctgaggaactgcacgaacagactgagatggagcaggcaacaaacatcattctcagctgccatgcgttggtgcatattttctctgtctctctctctcgtctctgtctctcgctctcctctttatgcattaatcctgccctcacctattttcagatgagaaaactgaggctgagacccactcgagatcacacacatagtgaggggcagcgcctggaattgcatgcatatctcttagccactgagctacactgtcccatcagaactggagttagggtcatctgttcattccttatttcatccaccagatccttgtgtgtctaagaccttttagcaggtctggtgctgggcacctgagaaggacgtggaaaccatcaggacctggaaatcatcaagccaacacctcagtagtgatggaaacccagagagggcactgtggggcatcccaagctcatcctaagcaagtagaagtcagaatgtgcagaggtcgggagcaggggatagggaatgagagctcctggattcaaagcctggctctggagctctcaaggtgtgggctcttggacaagctccttaagttctctgtgcctcagttttctcatctgtgaaatggggataagaattgtgtccacgtaagataatcacagggaggcatcatgagataatgtgctgaaacccttcaggcctggggcttaacacacactcctatgtttacctgtgattagtactattaggcagtcagcactcaaacccaggtctctccgtgatggctgaggcaatcagctctctgcccctgcaacaccaccagtacacccacccagaggtgttggggagggctcagctctgggtggagctagatccccagagcctgagaacagtgtttagggcccgacagtgtggtcccaccccttatgggctcctatgagctgcctgcctgcctgccgagttgctcaatcactgacttccccaggaaagcactaattacagcaaagctcccctgggttcagtgatctgtcacagcccctaggcatcagagcactggctacagtctctacagcaagcgctgtcctgccctctgccttcgccctaaggggaggacagaaaccacagggatggacagactaaccaacacggaaactggggccaggcttacaaaggagtctcaccttggcttgaatggcagtctattcagcggttctcaaagtgtgatccctgaatcagtagcgtcagtatcacctgggaccttgttagaaatgcagattttcagaccttacctaaggcctactgaatcagacactccatggctagggccctggaatcagtgttttaacaatccctccaggggctattggtatcagctcacgttgtagaaccaaagctctgatgcctgtgcagctgtggttggatggaggcctgtggagaggcgattatgaagtgggatggattgaagcacaggttcatagagacccaccttcaaatccaggctgtgccaattccttaccctgagattggatcgtgggcagagagcttcatttatttattatttttacttactattattttagagataggttctcactctgttgcccaggctggagtgcagtggagcaatcataggtcactgcagcctggaactcctgggctcaagcaatcctcccacctctgcctcccaaagtgctgggattacaggtgtaagccaccatgcccagcccagtttttaaatttaatacatatttattgacaacctattgtttactgttaaagaccctggagctacagctctgggacaaaacaatggcagcggccaacacttaaccgatattaactcatttaaccctcacaagaaacctttcaggtaaggtcctatcattaccccgaaggaagcacagatcatcaaaataacttgccccacggggctagtctgagagaccgctggagtgcaagccactaggataaactgacctggagctagttagggagacagacaaaatgcagtggagacacacaatattagcaggtcgtgatgcatgctatgaagataaaatagggaagagggtagggcatattgggcaggcgtgagggtgactactttaacagggtggtctggcaaggcctctcaaggaggtggcgtgtgagcagaggcctcctgaagtctcagctgcctcatctgtagaatgagggaatgattagctcacccccccaggtgtggtatgaatgtcacaagtctgtaaagcatagtagctgctgaacagatgggaattgttactgtttggaaaactgagttcaaatcctgactggtctggccacccagacaaagggcctgttgtgaaccttggagattacccttactctgtaagggccggaggacatagcaggggctcggtaaggtcactcccatctcccatccccccaaccccacttgccttccagcctggtgagcagcaactcttggggcagttggttccctggtccaggctgcccaggagtccgtgctgtttttatttttattgttctggcttcacagctgagacctctaactccaaatggctcttcttgcccagaaaaataggtcgttggcagctccagcctcctggcaggcctgcctgctgacgccagcccagggttacgggaagtggggagcagagcgcgggcagggctggaaccaggtgaagctgggctgtgcaggtgccagcgtgccccacagggtggccctggtcaagtcgtgttctgtctctcagtgtgtttcctcacctctgggaacaccgcggagttgctgaggcttcagtgagataatgtatctcaaaggacctagaacacacaagggtgtcatctacccccctgcaaaggccaaactccagataggccctgccatgccatcgtggctgctttcacatccttgtcactactgacccctcgtatcagagtttgttatccctatttcacagatgaaaagactgaggctcaatttttttttttgcccaagttgcataagtcaaattggcaaaatcttggcttccaagcccctgatcctctccttctcatgcccatttgtcttcttcccttgacaacagggaaggaatgtgatctgacttctgtgcaaggattcctcgggctggtgagtgaggaatcgacagaaggcacaaggtggaaatagggcgcccaggtgagagcggtggaggctcagacgagggcggaagcagcggaggcgctgagaagtggtttggccctggttgtgatgagaaggcccagcaggcaggatttgctgacagattgtgccctctaggagtaagaggaagagtcaagcagcaaaagcagggatgcaaccacccctggcttcccatctcacctcctcggtgagaccttccttgatccgttttcaaaattgcaatctatccctctcatcagcactcctgggcctcttccctggctaattccccccaccccgtagcacctgtcccatttgacaaactaaataatttacttatcttatcggttcgtttcctcccactagaatgtcagcttcttgagggcagagatttttatctgttttccagctgttgcattcccagtgcctggcacctagcagatgcttaatactgttgagtgcgtgagtgaacatgtgtgaaggcagttagattttaacgcagggcagcacagacctcctgctgtgcgggtggctgattcatgtcaattatctgccataatctctctgtgtggcctcagacaagttgcccctcacatcagtctacccatggcccgtgggtctcaatggcttctcagccttgaggttggccaaggatgatttttatgtggacagagaacaagggtcagggccccctccagggggagaggtgagggaagccctgctgagcgcctttgccaaaggtgctata

SEQ ID NO: 616 - DNA, 36620 bp, Homo sapiens
gcttagtggaacactttctcaggagactaaatattgtattttaagtgaattgctttcatgaaatttgccagaaaatgtgtttcccatgtgaattggtgaaaaaaaatcgacttgtatacatgcagaaatcagaagagtcaaggagaagaaaaccacaaatcctcttctccccaccacatcacctccctgccctcatgagcagcatctgcggaaatttcatggaataagatcaagggcaaaagtgtttgagaagagtaatggtgaaacctgtgatctctagagtcaaagtgcctgagttcaaatcgtagctctaccagttaccaatgagtaacctaggagcactttgtgcttctgtttccttatttgtgagggagggtgaacttggatataatggttacctgatgtcagaaatgtaagtgatttcctacagtatctggcacacggtgggtattcaaaaattgtaaagtgattacttggcagatttcctgaggattggaggcttcaatggatattagatgatgatatggttatggatatggatatgaatataactatagatatagataatataggcagggttctctgttacttttatctccttctttcttcctcaaccctaccattaatggaagagagaactcaaagagaggaatgcgcaaaagttctgttttgaggaaaagtgcattttactaagaagtctgcttacctgttgctttgcttaacagattgggggattttcaggggtaaatgactgaagtagaaaggagggagaatgactgggcaacagagaaaatcaaacatctctttaatgtgtttttcctgtagactaaaaaatgagttgaagactgtagtaagggaagtcttactactactactactactactactactactactactactactactgctgctgctgctgctgtgtgtttccacatggtcaagtaagatttatcccaggaattcaaggatggtacaacattcataaatctctaaatgtggtacagtgtttcaacagaaagagggacaaaaaccatatgaccttacaacacaggcaaagaaagcatttgacaatatttaacattttttaatcataaaagctctcaagaaattagataccaaataaatgttcctcaacacaataagggccatacaggacatatccatagctaacatcatacccaatggtgaaaagttgtcaccttttactctaagatcaggaacaagacaatgatgcccactctcaagttttctattcaacatatagtatcagaagttctatccagaataattgcacaaaagaagtaaataaaaggcattcaaatcacaaaggaagaagataaattttccctgtttgcatatgacactatcttatatggagaaaatcttaaaaatctctaaaaacttttagaatcaacaaacaaataggccacagatataagatataaaattaattggtaaaaatcagtagtttcatacacttatagcaaattagtgggaaaagaaatcagtaaaacaattttacttacaattgctaccaaaaaaggtaaagcagctaggaataaacttaatcaaggagctgaaatacctacacactgaaaactataaaacttggatgaaaaaaatagaaaacaaataacagaaagatacctatgtttgtggattggagaattactattgtaaaatgtacatactacccaaagagatctacagattcaattcaatgtcagtaaaatttcaatgaaattccacagaaatggacaaaacaatccttaagttcatattagccatagaaaaccatgaatagctaaggcaagctttagcaaaaagaacaaagctggaggtatcacactgcttgatttaaaaatcttctacagtgccacagtaatcaaaacagcatggcactggcacaaaaagagacacatagaccaatggatcagaccagagagcccagcaataaactcacacatttgcactcaattgacctttgacaaaagggtcaagaagacacaatggggaaatgtcagtctcttgaaaaaggggtgttgggaaacctgaatatccatgtgtagagaaatgaaattagacctctgtctcataccacatacaaaaatcaactccaaatgtattaaagacttaaatgtaagatctgaaactgtaaaagtactagaagaaaagttccatgacattggtccgggcaatgaatttttggatatgagccccaaagcacaggcaacaaaagcagaaataaataaatggcactacaacaaactaaaaagtttctacacagccaaggaaacaatcaacagagtgaagagacagcctacaaaatgggagaagatattttcaaaccatacatctgatgaagagttaatatgcaaaatatataaggaagtcaaacaactcactcataagaaaacaacccaagtaaaatatgagccaaatagccatttctcaaaagaagacatcaaaatggccagtcaacatataaataatatccaacctcatcattcttaagataaatgcaaattaaaaccacagtgagctatcatctcacgcttgttagaataactattatcaaaaagatgataatgactatcatcaaaaagatgttggagagtatgtggagaacaggaaaccctgttcccacacagttggtgggaatgtaaattaggccatccattagcgaaaacagtatggagtgtcctcaaaattcaaaaatagaattatcatatgatccagcaatctcactactgagcgtatatccaaaggaaatgacatcagcgtgtcacagagatatccgcacccccatgtccattgcagcattatttacaatagccaagatatggaatcaacctaggtgcgtatcaacagataaatggataaagaaaatgtggtgtatacatacacaatggaattctaatcagttgtacaaaagaaggaaatcctgtcatttgcaacaatatgaattaaccaagatggtattatgctaagtgaaacaagccaggcacagaaagacaaacaccgcatgatctctctcatatgtggaatctaaaaaagttgaactcaaagaactagagtagaatgacggtttccagggctagacaaggggtgcagttcggtaagtattagtcaaaggacacaaaatttttgtttagatgggagaaattagctccagatatctattgtacaatatggagtctatagttaataagatgatttatatccttcaaaattgcgaagtgcatagattttaggagttctcgccatacaaaattgtcaatatgtaagattatgcatatgttaattagctgaagttagtcattcagaaatgtacacatatgtcataatatgttgtacatgagaagtatactgttctcaaattagaagtattttcttaagctttaattgaaattaaagttggagaaactgataaaaaatgaaatctcatgtgtgtgcgtgtacacacttacactcacttatatgcacacatgcagggatctctaatccccaggttgtggttgggtacaggtccgtggcctgttatgaactgggccgcacagccggaggtgagcagccagtgagtgagcgttatcgcctgagttctgcctcctgtcagatcagtggcagcattagattctcataggagtgccaaccctattgtgaactgtgcatgcgagggatctaggttgtgtgctccttatgagaatctaactaatgcctgatgatctgaggtggaacagtttcatcctgaaaccaacctccccacccacccactctgggtccttggaaaaattatcttccatgaaaccagtcccaggtgccaaaaagattggggaccactgcacacgtgtgtgtgcgtgtgtgtgtacacattcacaaatatatataaaactgtgacctataatatttgtcacatagaaatcatccaacagattaacaaaactttcggaatacaaacatataccagggttttaactctgttgctgactggtgtaatgggtgatgattaatcctgtgtctgctttcctgcattttctagtatttctgcaggtagcataagaaggctaaaagtaggaactctgaagctggtcgacctggacttgaatcccatctgctccactgattgaggtagggaacgatagacaagttcctctctcagcctgcctccccatttgcaaatagggaatatgagttgtagctttcacacagggatgttgtgaggattagtggagttaaaacacacagaatgctaagaacagtttttgcgttataggaagatctcaattgctgaactattactgctgtcatttgaatacagtgtatggtaagaaaaatgatttggaaagtgaaatttctgccctctaggacttgtgaggtggcatcacagcagggcccagtggggagctgagaggctgctgtgcccagcgctgtgaccctggtgtcagctccatggcctgagtaaggagtgaggacaggaagcctatctgggagctgggagcaaagactttccaacctgcccctcctgaggaagggaaaataaattctccatggcaaagtcaagagacccaagggagattatggtacctgttatgggctgaatgtgtcccctaaaaggcatgtgttgaagctccaaccctagcaacacagaatgtgactgtatttggagacagagtttttaagaagcaattcagttaaatgagttcattggggtgggccttaatccaatacgattgatggtctcataagaagaggagatgaggacacagacacacacacagagggaagaccatgggttgagacacagggtggagactgtcttctacaagccaaggataaagacctcagtagaaattaaccctgctgacactttgatcttggacttcggcttccataactgcaaggaagtaaatgtctagtttcagccacccagtctgtggttctttactatggaagccctaggaaatgaatataggccccaataagcagcaaatgcagaacttgttaaagaggaagaggtgaccaaaaaaatgggtgttaagactcaagtcacaggggagggaggatcatgggggaacacaggacaaaataaggagcacccttagggaggacggtggctgaacatccctgggaaacactgcacccctgtccaactcaagcaggcaccatttcagacttcacttcctctgggtattgaatacagaaggctgggcctggagccacacagccctctcaggctgtctctgagctcactctgtccttgggtaggttgtttagccccagagtctcaagactggtaaggatttaaatagtgattgttctgtgttagtcaaatgaaatagatcaaaatgtaagtaattgtggtggtgagtcaatcatcctgtgacttgatgcctctggtagccagctgctgatccacagagaaagtgctcagctccatgatgtcctgctcttaggccccatctctggccttccttggcagcacttgtggttgtctggaatccccaaaggtccagggacaggatatagccctgccagcggagagaaagggttctagcccaaggcaatgcttacctgtgagtcccagcaatagagtcagcagcaggaaaggacaaggagggtggggccaggaggctgggacaggcatcctggagacctcaggagcctgctctgttcaaacgtctgtggtggggagatgtcaggctctgctctgaggagagaagacaagccctgcctccctcagttcaagaggaagtggctatgatggattgcgacagcaacttgcttctagattgtaacttagaaatcaggcacagcaggcagctacaaagcacagagttactcatactccattttcaggagaatcagacaggctgagcaaaaataatgcttcctcttcaactgaggcctgtgttctgtccacgtggcccccttccccatcttcaggtcttcttgatgatttgccagttgagggtcttgggccaagaaggtctgtggttgtgagttgtgtcctaaactcttcatctcaggaccctaggatgtggttggcttgttgcttcgttctgcaccagcctcaaccaagtgctactcagcagggggcaacaggagggatcgcaggagcctcttgatgttggagaggaaacaggtatgctcttgaaatgattccttattcaaaccttttaatgatataactggcaaaacgtagctcaaattcagtctgatctgaactttggtactttcatgggcctgaatccagcagaagaaatcatttcccaacttcttccaggagagggagtagttttagtttagtaaggatctgttttgtcgggtgaagtgaggatcatgggttatggaaaagggatagggttatgattcgggcagaatgtggcggacaggttcctgaggtcatcacatcaactttaatatcctttgttctgcacagaggacctacttcattcaccactgtgttcagatgggaaatgaggagagaggaagtatatatgccctgaccaacaaggtgtgctaaggagttggggaaatcattgcagccatctacgctcaattttgttctctaaactgggggttataagtatttcattgcagtgttttagtggagattaaaggagataatgattgtaccatgcctgaaacccagtaggtcattattgatgctaatgacaccaggtgaagagcgggaactcgagtggtgcttttgaatgaatccctactacatggtgaattgcccaccagtggctttctcccagcaacccaggcctcctgagacccagattatatgatgtgcttggactacccctgccactctgagatcaattgctttctcttgaattctctgcatcctgctccttataatccacaaattaatttgttctctcacaatttccagctgtgtgactttcaagaagacacttgacttctctgagccttattttgatggtatgtaaatggaagttataacatgcaccaacatgcaccttgtagagatggggtaggaataatataaaccataatgaatgcttgactcataattaattttaaccaaaaaatgtggctataatttttttttatgagaagggctcactgctttcctgccacagttgtgctttagaaaaaccaccttgttaggagaaatgtttgtatcatctatgacttagaaaggcctgtctggaagcttccctgtcacatgctaggttttaggtccttcatctgttattgtcaaatgaaatgtaaaggttatcatattctcattcaaagttctgttcaatgtggcaaatgtgcacagggtgaaatcttcccctcctactccacacccacaaaaatgaaaatgaaaaaggataaaattatattattccgtgtcaaattacacttaaaaacaagacaatagtctttatgtgacatgaaggaatagcagcagttatcatttattgcagaagtcctgtgccccagatatggtgtcaagcattttatgtcagttacctcattaattcatcactctgactctatcaagtaagcactgctattaacctacctccttttacaggcgaggaaacctgaggcacacagagagtaatggatttgctcaagatcactaagcttttagaactagagcataggttgccacacaccacagacttcacttttaatgtttgcactatgacatctgtcattggaaaggagagacatccctcaggaggaagcagagaagaagccatagcctcagttaggaacagcccgcacagtgaggctgtggcaggtgccatgctccaggaggccctgataactccatcacgtggggtggggctttatttctggaaagatggcagtgcaggaaggaatcactgaagatgtggggaacagcagcaccatgagagatagctaaccaattcaagaaaaacaataactcaaaaacaagaacagcaatcaagaggacttcacaactgagaaaatatgaaaaaataaaatataaaaaggtctttaaaattagcatacacagtaaccttataaagatagcaaaagggaagtgaatccataaaataacatcaggcatgtgtgaaacaggaatagtcaggcatgaagtaacaggtatcttggaaaaataaccaaaaaaagagactttggaaatgaaaacataattactgaggacagttttaaaaaatgtaataggttgactaggggactatatatatataagtagtaagttattgggttgggggatcatgtggggaaatcccttaggattcagcacagagacacacctaaacagagtaaggtaaataggtgtaaatataggaataacaaaagatatctcacaaaacatgtcaaaaaatttcccagaaacagctgaggagctgagcacttgcagagagggtggtggtgcccagggttggctctgaaggcacagtgatgatgatactgaagatatttcactgtttgatttagaagggagggcagacaactaatagaccaaagaaatttaaactcagagatccagtggcctcacttttcctttaattatttcaagtcagtgcaatcgccacctattttctctatgaaccgcccagcagttgctttcttgcctgtgtggcctgtgtggtgacaatgatctcgttgtcaggtggcttttgggcagtgaagaatgtcaccggtagagtaatgattggactatgttggtggaatcacattgatgacaatggaaagggccattgggcatttgagtcctgggagacatcctcttaagagagtaaaactgtcttagaggctgaaagaagaatcttctggttgggactaatggcctgtccagtgctgtgagtgatatgtgcttttagtgcctgatttgatttggctctgtgtccccacccaaatctcatctcaaattacaatccccatgtgtcaagggagtgacctggtgggaggtgattggatcacatgggtggttcctgcatgctgttctcatgatagtgagtgagttatcaagatctgatggtttaaaagcgtttggcagttcccgccttgctctttctctctcctgctgccatgtaagacattccttgtttccccttcaccttctgccatgattgtaagtttcctcaggcctccccagccatgcagaactgtgagtcaattacacctcttttatttataaattacccagtctcaggcagttttgtttgtttgtttgtttgtttgtttgtttttgacacggagtctcactctgtcacccaggctggagtgcaatggcatgatctcggctcactgcaacctctgcctcctgggttcaagcgattctcccacctcagcctcctgagtagctgggattacaggcacccaccatcatgcccagctaatttttgtattttagtagagctggggtttcaccatgttggccaggctggtcttgaactcctgacctcaggtgatccgcccgcctcagcctctcaaagttctggaattacaagcatgagccattgcgcccggcctcaggtagttctttatagtagtatgagaatggactaatacagtgccctcttctccttcagagtaaagtggttgaacgctagacatgatcagacttctcaaatagagggagaaaatttatgtgttttacgatgttggggggcaacctaagagattcttgactctgaaccttttagatctcagtttatgttgcaacagaaagtgttggcttttttccccccacttaataactttatttaaaacaaacaaaagtagttttcatattaagtttttattttctctccagcacttggggctagaaagtgtgttgtcactacaaacgtccaaatttatttaatggtatacagaggtatgcacaaggtcatgtaatatcagtatatcccaaattaaccaaagtgtgtttattgatatatgtaatgaaggcctttgctatttgatccatagaacatagtatgttcttagtctatttcaaagctctatgtgtttacatattatttctgtagattattttcagaagcaagttttgtttccacagtatgagtgagcacgttggctaatgtgtaagttagaaataattgataatttttaatatgtacttcatggtaaaatttcttagacatacataaatgagtaaaaacgaaatttagggaattggtattagtttctaaagttttgtttattttcatttgtaagaagtcatttacttaaggtccaattattataaatgaattatcatagtttatgtttaaggaatacccagaaattgtgctgttctacttattttataagaggatagccagattttactttggagcctcctggagctcttcaatgctctttggcctaatgatatctatcttttattactaaaaacgcattatttttatgttttaatgagaataatcatttacatacttcacataatgggtaaagacattttgttttatgaatctatattttttcttactataatgagaatgttatagattatgcatttgtattaatggcatttcttaaagcagtagatttaattataaactaaagcaacctagaaactactgtaggtatctgtaaattgtgttgtaggtactatagacttagtggagtctcttaatcagattatgttgtgaatacatttgtacattattaaaatatatttcaagatgttttgctgattttaataggtgtctttattggagtgataactttaaaggtacaaaactttatatttgtataagagtctactgtttacgaaggaaaaaggaaaaaaaacccagaaatattaatatctaaagatttataatttaaggtaaaacataccagtggttgaaagaggaatatttccttccatgaaaatagcaattggcttggaaggtgtgagacataaagtttcatgcctccaaaaatcatagtttggaatacaggactccaaaattgatgcaataggccaggtgcggtggctcacacttgtaaccccaacattttgggaggctgaggcaggtggatcacctgaggtcaggagttcaagatcagcctgaccaacatggagaaaccgtggctctactaaaaatacaaaattagccaggtgtggtggcgagtgcctgtaatcccagctactcgggggctgaggcaggagagtcacttgaacccgggaggtggaggttgcagtgagctgagattgcgccattgcactccagcctgggcaacaagagcgaaactccgtctcaaaaaaacaaacaaacaaacaaaaaattattttaactgatgcaatagtgtcaggaagatggcaggatccgtgcttggagcagcaagttgccttcccaaggaaggaactgtcaaggagttctcaaggaactccaatccttcaatgaagatatgctagatgcatagatgcttattcaagtaaaaaatttttgtagaaatcacgtgcagaattcattttcaactttagattgacttggtgcaacatggataaaattggaatatttgaaagaacggggagcctggaagtccatgagctaaaactccccccttcatctaccatatttcgcccccactcacgacattagatgcagatgacgagggaagactttgggacacatgaggaactgggagcccatggatgcctctccagaagactaaagattaggcctgtgggcttaggattaaaacttcctagtctgaaatcaagctctaccagctcccaagtgtgtgaccctggggacactattaacttctctgtttcttgagtttcctcaactgtaaaatggacataataatcacaccaacctcataagattgttatgggaattaaatgaactgatatatgcaaagtgcctaatagtatctgactgtatcctcaaacctagatattcagttttactattattattatacatattagctagacattattgttgttaggtagaattttagtaatagcaacaattttaaaaaacagatcctctgccctcaaggatttatgatgttatgtgacaacctcggccaatgtctgggggaggtgggggtaccatggtgatgagctgaggtcatgtgcttagccctagaatcatgggtgctgagatcatgtgctcagcaccaaggtcatggtgcagccatggcctctggggagaatcactatgactagggcaaggtgcatcctaattagggtctacacagatgctcatagaaaaagtgctccaaatcttgcctcatgctgggataggagacaagaaaatgctcccaagtggaaatccagaggaacaggagagatggactgagagggagaggagacatcacatagaaatacacctgtatagagcaggctgcacacaactgtgagtcctatgagcagagaaggtggcagggcctgtccaggtgagctgggacacagggctggggatatctgtctgaatgactctcatgaagagacctcagactctatgctctgcaggggaggagaagccccaccttgccatgatgtcccaggagggaagttgctgtgggaggaaggggccatgagactggggccatcttccattgtgaaagaggaagtggacacagttgccactgctaggaagttgctgacgtctgtgcttggggttcccagacctgggagccttggacagtactggagagaggttgactgacatagagcctgctctatgtcccagagactcttacctcatgccaggggtcccatgacccttcctaatttgagagttcagacctatagggttctgtagccaaggattgagcttgcagcttcagagaccataattccaggtgtggcacatttgagggcttgtggctacagaagcctttgggggtggaaccaaatctcctgggtgacccctacaagaagtctctcaaaccaacaccaactaacaagctgagcaaatcaaaaaacaacaactgctcttagatctgtcggagaaatgaggtcatagggcaaaattagagagacagcagggtgatatggagaattacaacttcctgaattagaaacctccatgggaaagagtgctggggtcagaaaacctgcaccatgaatggtgaattgctataagttcagtgaggaccagtctgagctaaaaactcaggaggacccagtcatgggaactcccacacttctgtgaattttacctacagcagcttgattggtcctcatagtgggtatgagagaaatattcagtagtgcttcctgaagaggaaggagaaaggggaccatttcaaattataccagagtgttctcatcatcttatgcttgttccatatcagaaatatacaagaagacaagcactgttccaactatccttgctatgttttacaaagaaataataatttaatcctcaatgtttctaatcctttgaattaccataaactaaatatttttcccttctgtccacatttgcaactgataatattatattttctaatattttgacaaaaattatgaggaccacagagtagtcattatattcccctttggatgtagagttgctttccagggtttcagtattttcacagtcgtttttgtaatcttgcactaccatgcaaagtgaggactgccctgtatttagtataatatatgtagtaatataatacagtgctaaggagaaaagctaatcaaattaagagacattggaatgctagggtggagaggaaaatggatattttacatagggaggtttacataagttgcctttaataaactgaaggacagaagagtgagccacgcagctgttgcggggaagaagccgaggaatgacaggatttgacttttccaaaaaataactgaggctggaaaaatgcaatccatcagaggctctataagcggtccaggaggagatgatgctagctgggaccatggaggagtggtggaggtgagagatgtgcaggttatgagtacaactcctttgtgtgccggagcaggcttggactggctcaggagaaccaactgttaaattttcaggaattgtgtattctagttgttaaagtgttagaagcttgaaatgggccatgttggggatattcaccccatagaaattgacaaacactacaattcagccttctgttttctttcaaacatttaccatctatctcaccaggggacataagcattttgaagcagaactgaatatgagatataaacaaagaagaaatcaagaaggacttcacagctttagggctgtcacagtatttttaccatgagcaacagagttgggaaggttgcaggatgatagaaaaactagtgtttccatcacagagagaggagggagagatgctttctttctaggtgtgaggagtaggacactgtcttagtccatgtatgttgctataaaagaatacatgaggctgggtaatttataaagagaggtttatttggcttttggttctgcagactgtacaagaagcatggtacttgcatctgctgctgagggcctcagagtgcttctgctcacagtggacagtgaagtggagttggcataacatggggagagaggaagagaaaaagagaagagggagctgctaggcacttttaaacaatcagatcttgtgggtgctaatagaccaagataacaccaagtcattcatgatgaatccatccccatgacccaaacacctcccacctgaccccacctccaacataggggatgaaatttcacattgagatttgtagggaaaaaatatccaaattatatcatacgtataaacaaagaggaaggataatcatttttctccttaaaaccaggatgagtgttaatttgtattcaggaggcaatagagaatctcaacaaggctgggtaattgggtaggcaggaatccagaaggcagaataactcttgagaatctggactgcagtttgtggcttacggagagtccaagacgatggaggagaggtgtcctgatgtgtttagatttggcgtgtttcccacatcctagggaggtgtcatgagtcactccccagagccccatcccatggcctctgctcaggaccatgaatgaagactgctctggagaatcaaggactctgcaaaggagcaacaggagcctgtgggcaggaagatgtcctgggaggggaggtgtttggagctcagtctggggaagcttctcaccagccccttctctcagtcagagccattcaaggaaggaagtaggcaggagagactgggggttccatgtggcaggggaggagggaaggagctgtgggtaacatgtccatatttaatcatctgctcatcatttaagaaacatttcctgggaggctgttgtattcctggtgctggtctccttctgggatgcctgttgcaagtggagaggcagccctgagataggactctgctggctcagccctcctcctgagtcttgatgcctctctcctcattgcttccactcaggcacacagagggtcagaatgggtacagccctaagagctgcccatctgtggtttctcaacatgacttgacagtgaggattcttttgggcccatggagatcagcatcaaataatctagagatggcctgcaagggaccacccactcagtagcccctgatgcatgctcctcttctcacctcctcatgcgaccccttgggtgctgtaaaaacctttaaacaccctggctatagctcacctcctcaagcactcacacacttcctggggttgggagactcttagagtcctgactcttagagaccctgagagtcctgaggatgctgagggagctctgtcaccttctctaaactccactgaccctgatgctgcatgatatgtgggctgggccctcctcctggccctgcccttttggagcagcccttggtcaggcatccatcccccacacttacagtcaggccttctgcttccagtagacatagatgacagagacaccaaccaccagcagcaccttggggcccaggaggaaagctatgagaagtggagcagcagaagccagtgctgggcctggaaatcaggagacaggagaagttaggaaggggctacccaggatgccatcccagaggcccccacttaccccacctgaggctacctgggaccatcaatgctccaaagcttttgaaactgcatcttaccctggctaccctagctccaacccaaggcagaagccagggaaagaggttcctcattcccttaccctgtcccaggctgccaggttgtcctcccggagggacgaagtggagagaatgtgtactcatgcattcatgtgtggcacctgagtccctcacttgatcctcacaagcctgtagggcagggattattattccattctgatggggaaattgaggctcagagaatttagggagggtcacaaggttgctcgcatccaaacttagggaagcccatcattatgtcccttaggatgattcctgagactgcgtccttttgaacaagacaagtccaatttcccagggtcataggaagaattacaaaagggaaagtaggtgtcatgagtataactgagtacccccagtttgctaaaaaacagtttattttctttgttttctttcccctttccccctgctcccagtttcctacttagcccttcagaaatgcaaatataacctttcacctccccctcaccagacattccctgcagggcaagttcttctgtatactccaagacagatctctcctggagagctggcacaccaaagcatacccaccatagaaacttcacctccaggggtagcctccagactttcatccaccaggagggcatatggaaagcatgcccccttggccacgtttgcaacttacttctgctcaggatgacgccacctcaactgtcaggtagctaagtcaccaggctagtagagggacccctgcccttgttcccatccccattaccttataaaagtgtctgctttcttctccaaaggggaagcagcacatttgaaagcaggacacgttgtgtcccttccccaacctagctttggaataaattcacttttttttgtatcagacctcgcgctccttgattggattctacatgcagcaagcaactaacatgctttttggttatatgaagatggcttcagagtgagagagttgcaggctgctctgtttagccccagtggtgagggttgaccccatgttcttgagagctggggaggcccttgaggggctgggcctaatgtactgtggtggatagaaaacaccctggcatgactgtcatgcttgggagggactcagacatcaagctcacatcaaccccagagcaggtgccatctgaaatctctctgttggacacacagtcagatctggggaagcacacatttggattctttgcatttttacaatgagcatttttttgctgttaaaagcaaacaaatgaagatatgtttacttctgttttcatgtacgttttctgggaaataaaatggtgctgatgggtccttaaggaaggaatggagatctcagcatatgtggctggaaggttggaggccggcagttctcagctggggggctctctaggactttgtctcccctgaggagagctgcactctccaagtgcactcctccttctagggggcagcccatagaaagattggctgaattgaaaataggaaggccacgcctctctactcaattagcagaactctaagggactctctcagcccttggcttctctgcagaatcagctgggtctttgtcctgcctgcactgtggctcagcacgtccctctcctacacttctgcctcactccctcaggcatattgaccctgacagcactctagcatgcttcctgaactcctgtatccacctccagttggcctcctagcaaaattgacagtggaaatggtctgaaaagcagactctaaaatgcaagtttggaaactgaccactcatcaagatcagctggcaatgaggaccccagggctggtagtgaatggagctgggcaggccctggcttgcagctatggtgcaattaataaaactttcactgtcagtgaagcgggaaggaaattccttggcatcaggcatttgaaaccggattgggaaatgatagttatgaggactaacgtgtttgatggctgttgctgggcatcaattctttggggaaagacgatgagaagctaagagtaacttatcatgaattaaggctcggtgtaaaaaccagaggacttcttggcagcagtgtagattgttatctcctggagccagagggcagaaagaatagaagattgggttccagaacattataagagtagcagaaccacagagatggatgaatctcagcttcaatgggctgctatgctgggctagggccctgatggggaagttgtgggaccctgagatgtgggagggaatgtttgggtcaaagcacttacagatcatcagccatcttctgagtttctggggacagttgcagcagcataactaattatctctataactaacctccccaaaccaaaagaagaaacaaaaaaggaaaagtaaattttgcacaaacctgactctgagtatcacttggacaaagaatgccaaactgcaaaatgactgtgggtcaaaagagaaccttcaccacaccctagtgcacaatctcactaggctgccacgctgctggtgcagtatgtcacataaggcatcttgcatgttgtgtaccagcctagacaacctaaaacgcatttcctgccatagcacatgagcaaggatgctacatccagcacactgaaagcacccaaaaatggcagccctggtcggagctctagtgagtggatggaagtctaaaaagcaaattcagcttcagatagatggtgcagattcatctcttccggctcctccttgagaagtacaactaagaactctggaaatatgaggagcaggcataggagaacttccaaggtgaaaaaggaaggcagactggctagggatctgaggactgaggaacagccgtgaggccaggcacctgggacccacccccacaatatgagctcccagccatagaacatgacaaaaaaaatgacacagaaaagagaaaaagtctgtattcaataatataaatccccacttcaagaaactacaagaagtagagcaaaataaacccgaagcaagctgcagataggaattaataaaaaagagaagagagcagaaaattaatgaaattaaaatataaaaaacaatgcaaaaaccaactgaagcagctgatcctttgaaaggatcaataaaatgggaaaaaattatagcaagtctgatgatgaagaaaaaagaaatggcacattttaaatatcaggatgaagcgagggctatcactacagaccctgcagacatcaaaaggatcataagggatattatgaacaactctacacacagaaatatgacgacatagataaaatggaccaaaaactctttgaaaagcacaagttgccagatctcacccaatatgaaatgaataatgtgaatagccctaaactattgaggaaagtgaattcataattttaaagtaccccaaaatattcttgaggtacagatatttcatagaaaaatactaccaaacatttacagataaattaataccaaatctggtgcacagaaaaacgtttacaaaagaaatttggggaaatttgaatgtatgctccattttaggtgatgtgagataattattttaacaattttatgaaatttaatggtataaaattttaaattttatgaagtttataatgatattgtttttgtaaaaaatgtcctctattatcagatcacccaattgcggactcctcttgcaactgcgtgggcgcataactgggtgagcagtggatgtgacgatgcactttccatacatctctgattataggggacattgttgtcctccacttcctgtcttcactcttccagcagacaaatcagcgacccagcactgacccagtagataaagccaacgccgtagagtctgtggctgggccttctaaaagtcttctggaatagacacccctcctggtattatatgagagggaaataagatatattttggtcatagatgggggaacactggccaaattgacatccttgggacgatgcccagcagaaagagacgtttctcaaattagcataaatttgcattataggctggtagtgaccctgtcctcaggacctcagacttaccttaattagtttgggccagtcatctggtctaatgccttgatctaattgtcttcaacaatatcccccattgcttcccaagtcctggtttccccttctgtaaaactccagactcactggatggttgaagcaggaaaggagatcatagatgaacagaaacttgcacataataaatctgcagagagccattgtgattattattggtcaaatatcaccatcgggacccaaaggaggcccttgctttgaccactcatggtcacctgggggcgtggtccaggcttaaactccacatgtctttctgaaattcacacagcagatgcaggagtctgcagggggcaggtcacagatatgaatggaaaagtttaggaaggaacagacaaggcagaggtcagaaggagtaggaaggagacagggtggctgatgagaaacgggaatgtaacaactgtcaggggtaaaaagcaagatgcagaacgtgaggaacacatgatccccttgcctcctttcttcctcattcagcacacatttatgtcaaaaaatctgtcaggttgtacctcaaacttttaatagtgatgactcttggagggtgagatttgggagaatgatgctgactttaaaattctactttatacttatagacttctagcttattttatgacaaacataaataattttaacatgaaagaaaaagataaaatttaaaaatttgaagtaaccttaccaggagcagtatttgagccctgctccttcgggtgggctgagaccttcaggtcatggcttttgctgaccgctggctgcccgtcatgctccacctggcaggtgagcttcacatcatccctgtgggcagatacattcaccaggagccagctcatccagttgtaggtaccatccttgttttctgtaagggttgaggccgtttctgtcctggacacgtttccattctccaaccaggtcagctgtagtctctgggggtagaacttcctcacctggcaggtgacattcacctggttctctgccctcacgggctgttgagtaacctccaaggtgggtggaactgaaacagcacagggcagaagctctgaccttgtggcacagacagatccagggagggctccataacgtagctcccccaccacggtgagggcatcaccaggacagtgctaggcatgcagcaggtgctcagacattgagggtgctctttgcatatgaatgaaattactaagcacaacgcccagcacacagtaggtgctcaaggactggtagctcctactaggctaagaatgagggaaatctataagcaccacccctggcatgcagttggaatgctgtaactgtagcaaaataaagaaaatcaccaagcacatagaggcttagctcatagtaggtactcattaactgtgtttgctatcagtgaaataaatgaaacggctagcacagtccttggcacctggtgggtggtgtggtcacccagccactgccattaaaatgttagtaagtggctggcacatctaggggcatgggaggtgggcagttaggaatttaggttccaggcatttcaagccctggagcaagagtagagctggatgagtggagggtggtggggggtgggcttggtggtcaggtgtgggcttgggctgggtgagggtcctctacctcggatggtctcagacaagttggcagtcccacgaagagggtccccctgcaaggtgacgtgggccacctcgcagatgacttgagagtgaacgtcctcgcgggtcagcaccaccttggctgtgctgtggatgctgtaggacacactgtctcctgcggggtccacgttggtctggaagtctgagagctcattcccatttttgaaccatttcagggtgatgtctctgggtgagaagccgtgggactcgcaggtgaagctcactgtgtgctgaggtgtggccctcgccgcagggcccgataccacgggggcagagggtttggctacaaaaggaccatcgataatcaggagacatgactcagatgacaatcactaacgataagtgtgtgagatgttaagaaccttctgagacattattttttatccttccaataatgtggaaagattaatgagggtggtgtccttattgtcattttacagagcaggatgcaaaggttgggagaggtgaggacccatgtgaggtgagacagtgtaggggcagggcccagagggaagtccaggcctgagttcaaagtcctctccacacagggagacttccaccaatctgggcataggaacaaaattactgattggtctccctccatgttattaactggtcctagctgtcctcccccggaaggctcactaacctcagagagggcatttatagaagccaatacagggatcaatggcaaagtggcaccaccgtgagagctgcaaccaggctgctcagcccaggacaggggtgggctgacacccccagctcctcatccgcaaaacaggaggacggaggacggcgtttctacttcctgggatgtcgccaggattcaatggggcaatggaagcagttttgctctggatcaaacacagaagatgcttccccgaaaaaacacagatctatctttaacccagactttacagatacacagaggtctctctttaggtattataaaaatatgaaacattccgtatttttcttttcacaaatatttcgttctgtcaaataaaaggcattaattaaggataaagctttaacgtagagccaagagtttgtaagagcattggaatcacacctgctagaggtcaagccacaggatgttgcagtagatagacctggataacaactgaagccagggtccgtgggattttgatctctttcacctggagtactttaatgaaataaccaatgagagtgggtttgcagttgaggattttcaaccagctaatgaactgtttccaaaaacaacctttagtgaaaatcccctataaaaaaccggtcctgtattgccatacgggacactattcagggtttcactgactcagtgtacccaaattgcacctctttatctttcagataaatgctatttcctttggccttcctaacaatcattttgctgttgttgttagttgttctaatctgctggaagtcctaaatttgaaaagaggaaatttttgggaatctgaatcttcagttaggacaggtttgggtgaaaaacaaggatcactgagtactaagaaagccaaaggtggttagctttttcatcgttaattaattacaagagacaaagacccaggccacaccaacagacagaaacctattctgggccttgaaagcaaacacattggagaatcagaacaacgagtgcagtttctccatgtagatgaattttaagggtgtctgcaaattgctaattgttaccttgaaccttctgccgtcctcttagaaagcacatattatacgtttgactttgccaatattaacttgctccctgatatgcgtgaaataatgtgagagcacagtaaggagggtgtcacttgaagatgtcaagtctttgagacaccagcagcatgggtgtccctagaaggctgagaggctgtcttcagttccgattttttgagggcttcttggcagcctgatgctggctgctctctctgtacctctcaacacttcaatcctccctctatttgtcagagggggtcctcatgtgagcccttgtgtagggcgagactctgagaggatccttggtggccaagggccaaaagtagatagaaaccccaccctgggaagatgagtgagggtaagtgcaagggcatagcctggcatgtagtaggtgcttaataaatagcccctgtgactgtaatcatgaggtttggtcattactgcttctggagctgcatagctattctttaggcaacagaacaaagaggcacacaaacaccaaggaaaggctcaaaccctactcaccgcagctgccagaaaaaacccaaatgataaaaggagcagcaaccaccatgtttggcgaactggctttcaagtaagatcacaggggaagctggaagcattttggaagaaggagggaaaagatacctcagtgacatctgggagtgctgagggagggaggcttctggggctgaggagtgaggatttgctgggactccagcacgtgtttagatacaaatgttttcaagacagaaggttccccagccctgaggctgcatctgagccaggctttgtcccagtctcctatcttgggccctgaggccagtagcatgggaggggtcctgttcaggcttctggggcctcccagaatgtttccagaatggctgttttgaagcacccatgacccaaaaagctgttctcaaagccccaaaacctggggcaccgcttttgctagggggctgtgtatgagaatcttctggagccattaagaactttagatatccaggcccaaattagatgcaattaaattggcattttaggggggttcctgggtccagctttgcaaactttttttttgatagttttcccaatgattctaatgagcagccaaggttgaaagccactggactccaacccaaaccccatttatacttggggcctacagaagccctgacctgtctgaggtcacacagcttcaccctaacacaactcacctttattgagcatttactgtgtgcttgttgatgccctaagcattttacacaatatcactccttcagactcggcccagtctgtgaggtcagtgttaccatcaaagggtgaggacatcgaggcctatggtggtgaagcaccttgtcccaggtcacagagccaggaagtggcagagccgggaagaggcccaggcagctgggatactgcctgtgttctcctaacgacagttctgcagaagctcagtaataacctgaatgacaccaccattaggggctctgtgcacatcctctccaatcctcacagaacccagaataggccatgataatcagcatctcaccgatggggaaaccgaggactcaagggaaggcaagactggcccaagatcacacgatcttgaaataacacctcactttgggggtgcctacagtgcgctaggtgatttacagagagaaccttacgcttacgactttcctaaaggagtccatgattgtctctattctacagatgaagatgccgtggctgaacaaaatgaaggcactgtctcccgattctccatgtgtcccagtgggcatttcctgtgtcccaccaagcacttatgtccattaacagagcaagtgttctaacttcttgagctccaacactgactgccacctcaattgtccctttgagattctagacttcatgcaatgttagggagaagcctccctcctgggtgcccaggcctggttaccctgcagccataagcaaaagacagtgggctcctgacagccggaggggagaatctcaactcttgctcacatgggccccaaacactctctaggaaatgcctcatctcctcatccttagtcctcagcaccatgaacgggcagatacgtgctctgctgggctgcaggaggctcgactctgctcattggacgctgctgagtgaagaggaaacaacacaacatgggggaagagtcctaaatgcctcatgtgtgttgagacctgtcctttaggaaccggcttggcatatcatgagacacgcgcagggcctttctgatgggagtgtgaagacaggccctcctacccctacagggttcttgttttgtttttaatgctttttgctgtagaactgaacaatgcaagagtttagaaagagaaggttggagcatttctccactcttgaaaaaccacagttgagtgtcacaaagacaaaggctgtgagtcaggctgcggggttccagccttggctccctgacctgctcccaagtcaggtctcctctctgagcttcagtgtcctcatctttaaaggaggtagcaaatggcttctccctcatagcactggttataaggagactctggcacagttgctgctctctggcccccttccccacctccctcctttctcatgtagctcatcatttaggccgagagcatggcaaagaggagtgagtacttcactaggagtgagcagatctgagtcacacctgagccaccactggctgtgactgcctgggctggggaggcaccacctgggcatttcagtgtctttgccaatattatctgcacaatcaggaaaaagccaccttccttgtctaagttcaagggttgtggggagctgatttcagtcattactgggcaatgtacattttcatatacatacatgtacatgaaagcatcatgttttacgctttacatatacacatttttttaaaaagctgttagtaaagctatgtgtcttctggagattccgttttttgcctttccaaattccagaggctgcccacattcctttctcacagttacatcttcccatcactctaacctcttgcttgcaccctcacaaatccttctctaagaattaatctccttcctccttcttgtaaggacctttcttatgtattgtgtccaccccgatgctagaggcagatgttaaaaccactgtattaaaaatgtttgaagtggggctgggcacggtggcttatgcctgtaatctgagcactctgggaggctaaagtgggtggatcacctgaggttgagagtttgagaccagcctgagcaacaaggagaaaccctgtctctacaaaatacaaaattagccaggcgtggtggcctatgcctgtaatctctgattgctacatcatctaggagggaaatcaggcaatattctcaaatatgaaaacacactatcctgtgacctaggaacgccacttccagtgggtgtctcccgcctgagtagggtgacacatgtacaaggtcatccattgcatgattgctttagtagctaaggttgggaataacttacatatccatcaacagaagactgtaaaataaattttgatatttccatagattggagtatttttcagctgtaaacacactggagcagctctctatgtcctgacgtggaatctcgatatggaatgacagggcttacatttgggagaagttttccaatcacaaacaagctttagtatctgaatgtgaggtgcattcttaacatttgggaaactgatgaaaagagaaatgctggctctctgacacctggctctgtttgaggagcttttatctagcacctatgatgcaccaggctcttctatggagacagcgtctaacgctggggaaggaaggagactgccacgattcagatatggactctggctccaattctgccactaactggccctgtgaccatggacaaggcccctgtcatgtcttggcttcagtctcccatctgtaaagggggttgggctggatggtctgaaggtccttcctgtgctgacattccataattcaggacttaggacgaagctcttgggcctctgggaggaaaccccagataagcattgttgcagccttatatgggaaacccctaagtcacccacttgtgggacctctttcctgaggtgagggacattctgagatgatgcagctctgctcggagcccatggtaactgtgtgactcagtccccaaatcgcagaagggtttcccaaatagacccacagcaaatgccaaacgtattggcatctcctcccaccaggccatcagattcaacagtgaatgtgcctcccagaaatcttgcccgtggggtgtttctgaggatgaaataaagaaaaacacaatttaccctcttcatgagctggacagatttctcctcattagaagggaagagaatgtaagcttggtggggaagagctttgggctgtttcattcactgctgtttgcacagcatctagggcagagcctggcacacagtggggtctcagtgagtgcctgctgcataaagaagagacttggccaccctgagggggaagcgttctctggaggcagaaggcaaggtccagccctgtgcctgggcaagtcactcaaattgtcagttccctcatctgtggaaccaaagggctggatcagctttggaaacacaagagctgtagagccgcaagctggggatgccttctgtcccatcatttccaagccgtggagcctcgagcgactgccatgacatctccaagcctcaactcatgtgatctggagaaggggtgacatcagttcatgaaagggtggctgctcagccaccaccacacctgactgttgctctaagaatggataatgtaattattgagttattgtcacacactaggggatgaaggaagcccacgctgtactcaccacgcacagacagctcggtgcctgctccagacttaaactccacgtggtcggggctccctttccggaacttcacacagtagtaggtgccggcatctgctggggtgatgttactgatgcggatggaaaagtccatgttgtttctctttgtgaggtctgaaacagttgttacccgtgggaagtggccttctttctgattgtagattaattcccggcctggtccagctcctctgaaccactggatgggccccacagggatcagggaagtcacagtgcagtgcagagtggccgactctccagctgcaactgatatggacttgtcaggctgaatcacctgcagctcttcctcgccagctacccctggaaaggagcacaaagcagtcattttttcatccttacgtgatcctctgtgtttcctcaagtgtttatcaatggctttcattgaccgggtgcacaccaggaaaaggccttgagctcagcacactacacgtattatctcatttaaccctcacaactggcctgtgacataagactgtaatacaagcgaggacactgaggcacagagaggttcaatttctgtttccttactttcttttgttctttctgtttgctttttttcttttcttttctttttgtttttctttttcttttttttaagacagggtcttgctctgtctgctgcccaggccggagtgcagtggtacaatcacagctcactctagcctcaacctcccaggctcaagtgatcctttctccttggcctcccaagtagctgggaccacaggtgcgttccaccatacctggccaatttttgtgttttttgtagacacacagtttcaccatgttgcccagactggtgtctacctcttgggctcaagcaatgcatctgccttggccttccaaactgctgggattacagacgtgagccaccatgcctggccaagaggttcaatttcaatgtagagctttgggttgaggacctgagtagaactcttgagccctccttggaagtgccatgttttgctaaatatgtgcctccactctgtggctacatggagtgttgcactttttgcatcaatggattgggtggggccgtgtgacttctttagacccttgagttacgagcagaagtgatgggtataatttgtgggctgtgcatgtaactgcaagagcctctgtggatcaatttctcccttcctgagacccacaaggctctaatggggcctgctccattgcctggatgcgtgaatgaccgttgcatgcagaactgccaatccacactgaatatgtagcttccagtagaaatacaacattgttttaagccccttgtaatatttcacccatagcataaacacattacataagtttcctaatgctgatgtgacaaattaccaaaacttagtgtcttaaaacaaatgtaacattttatagttctgggggttagaagtccaaaatagtgttactggggtacaatgaagaagaaatgaagaacgtcaaatacacaaagatagagaataaaacagtggtgactaggggtgaacttaggggaggtgatggggaggtcaaaaggtataaaattgcagtaagtctgacgaagaagtccagagattgaatgtgcaatctgaggattctagttaataatgttgtattgaattctgtatttttgcttaaaaagcacattttaggtgctgttgacatacaacacatgcagcataactatgggagatgatggatgtgtccatttgcttaactttaataatcatttcactacgtatatgtatatgtgtacgtatatgaaagcatcatgttttacaccttcaatttccacaatttttaaagagctttcagcagagctatgtgtcttctggaggctctgttttttgccttttcaaattctagagttttctcacattcctttctcacagttacatcttcccaccactctaacctcttgcatcttcacatgcaaacatcctggaatacagggatgtttcaacgtcattctccaagaattaatctccttcctccttcttataagcacacttgtgatgtattagctccaccctgatactagacccagatattaaaatcactgccttaaaaatgctgagaggtaaaggaaataacggaccaagaactaaaggaatataaatgtcttaacaaaatgagaatgtaaagaaagagaaattataggaagaaatcaaacagaaacttaggaattgaaagtacaataactaaaagttcactagaggggtcccccagtgggtataagcaggtggaagaataatcagaaaactggaagatggtataattgaaattattgagactgaggtattggtggaaaatagaataaagtatagagcacagaatctaagggaattgtgagacgttatcaaatgtatcaacatacaccttactggagttccagggggaaaaaagagaaagagagaaaggaatagaagattatttgaagacatagtggacaaaaaccttcacagactagataaaatacaggaatctacctattaagacacagaagaaatgcaagttgaactcaaaaataaactcagagacccacactaagacacattataacccaactgttgaaaactaaagtcaaagagagaatccttaaagcagcaagacagaagtgattccttacataaaagagaccctcaataagattttcagctcagctcttatacaaagcactgaaggccagaagatagagggatggtaagttcaaaatgttgaaagaggaaaaatatgtcaatcatgaattctatacctggcaaagtgtccttcaaatacaagggagaaattacgatattctcagataaacaaaagctaacagagttcatgaccattaaaccttgcctacaagaaatgctaaagggagtgcttcaggtggaaatgaaaggatgctacatggcaactcaaagttgtatgaagaaataaagatatccagttatgtgtacatgttttaaaaatcatgcttcaatatcccacaaacaagctgtgagcaccctgcccaggtgaccaggtaaccagtattttaaagctggtccctgccacaattcctcttcttgtcctcctctactgtgacctagtgacattgaaacaccctagtaaaacccatcatggtttttgcttgtgtcctccaccttgactcccagtaaaggcacttgcccagggatcccatctctcttgcctacccatctgcttgattgagcctgctccttgggagctcctcccacatggcttcctgcatggcctgccctacttccttctctaggaactgtgagtatgcctcttcatatgaacttttcatggccatgttagagtgatcctcaaaattcaaccagcaggaatcactctaacattttcaatagtaatggcaatgaggatgggatcattctaaactcaggtggaaagttcctagggaatgcctttgactcatgacttactgatttgctactctgattggctccacaatttgagaaggcttttcaccctgatgactttcttgtgctatgctatgtacagctttgtgttgccttttggagtgctgccatggctctccatcctgaagcgaggatcctgttccaatatcaataatgacatctgcctttcttcaagagcacaagatgatataacattggtaacacctcttcaaagaagattcatgtgatatgcatattaatgtcacataatccagcatcagtaagttttttctggggtgcttgtggcaacatattcttcatttacaaattttacttacaaattaaaatcaacaggccctcctgttagtgtctttaaatgaattaacaaataaaagtatctcttctctgtagagactttggctgtgtctttcatgcctcttggagtctctaaaccactcatgatggccagacattttccccagggcctttgatgcaaatataatgcccctctcagcttttgctatactccattacaacaagaaatttctggttatctattgggctctcctggcttagagtccagatctggggagcatactttcctgtcgtactctttaaccataaattgtcccaaagccagactctgcttatctgaaatggagcccactggaatctaaacttccatgaaaatacaaaactaagatcactgccaggtagagctgcacacctttctgttaacagttggcattattattactcggtttgttgatgcaataatcctcaaccaaacactagctgagttcagcagcatattagaaggaatatacacaatgagcaagtggtatttattcctggaacacaagaatgtttcaatatacaaatgacaaagaatgtaatacaccatatttatagaagaaagagaagaaacacatgattatctcatttgatgcaaaacagcatttgagaaatgtggacatctttttgtgaaaataccatcaataataggaatatatgaaaatttctataagataaaagttatatacacataccttattttattttcccttatcagtggctaatttatgattttatttacctatttatcatgtatattgattactgtcattattatgactttattgaaaaaagaaatcagtaaggtaatcgcatttacaattactaccaaaaaagctaaaatagctagaaacagatttactcaaggacatgaaagacctccacaaaaaaagctataacaccctgatgaaaaataaatagaacaaaaataatggaaagatatccatgcttgtggattagataattacttttgttaaaaatatacatactacccaaagagatctacagattcaattcattattagtaatatttcaatgacattttcctcagaaatggacaaaacaatcctcaagttcacattagtcatagaaaattgtgagtagaaaaggcaatcttgagcaaaaagactggaggcatcacattgcctgatttcaaacttgactaccgtgccatagtaatcaaaacagcatggcactggcataaaaatagacacatagacaaatggatcagaccagagagcccagatataaacgcacacatttacactcaattgacctttgacaaaaatgtcaagcagacacaattgggaaaggtcagtctcttcaaaaagtggcattgggaaacctggatatccatctgtagaggaataaaattagaccttcctctcacatgacacacaaaaatcaattcaaaatgtattaaagacttaagtgtaggatctaaaagtgtaaaagtactggaagaaaagtgccatgacattggtgtgggcaatgaattttcagatatgagtcccaaagcacaggcaacaaaagaaaaatagacaaacggcattacaacaaactaaaaagcttctacacagccaaggaaacaatcaacagagtgaaaagacaaccagcagaatggaagaagatatttgctagccatgcatctaatgaaaagtcaatatacaaaatatataaggaagtgaaacaactcaatattaagaaaacaacccaactaaaatatgggccaaagatcttaaaacccatttctcaaaagaagacattaaaatggccatcagacctataaaaatactcagccttactattcatctggtaaatgcaaattaaaaccacagtgagctatcatctcacacttgttagaatggctactataaaaaagatgataactagttttggagaggatgtggagaaaagggaattcttgcacatagttagtgggaatgtaaattagtagagccattagcaaaaacagtatggaggctcctcaaaaaattaaaaatagaactatcatatgatctggcaatctcactattgggcatacatccaaaggaaatgacataagcatgtcacagagatatctgtgctcccatgtccattgcagcattatttacaatagccaggatattaaattaacctagatgtccatcagcagataaatggagaaaggaaattggtatacacaatggaattctaatcagcctgaccaaagaaggaaatcctatcatttccaacaatataaatgatcctggaagatattatgctaagtaaaataagccaggcacagaaagacaatactgcataatgtctctcatatgtggaattttaaaaagttgaactcatagaagtagatagtagaatattggttaccaggcactaggcagggggtgcatttggagagatattggtcaaaggatacaaaatttcagtttagttaggagaaattagttccacaaatctattgtacaatatggggtctagagttcataacacaattcgtaacctcaaaaattgttgaaagcagattttgagagatctcaccacagaaatgatacatatacaaggtaggtcatatgttaattagctcaaattaggcattctgcaatgtacacatatttcattaatatggtatacatgataagtatatacagttctgtcaaataaaaataaaatattttgttaaaagtttcattgaaattagaaacttggagaaacaatgataaaaaatgaaatctcctgtgtgtgcatgtacacttacttatatgcatacatgcatatacatatgtatacacacatatgtatacacacatttgcaaatatatatacacacacatatatgtatatatacacacacacacatatatatgtatatatagacacacacatatacattcacaaatatatatcaaagtgtgacctattgtgatagtatataagtttgttttgtgtattaaataaaattacaacacacgttaaaatctcattaaaatatctggcccatagaaagtaaaatatgtggcccatagaaagcatccaacacattaataacaaatttagaagtacatacatcacagttgtaactctggttgttgctaacaagtgtggtaggcaataattaattctatgtttacttccctgcattttctaatatttctgctagtagcataacacgactaaaagaatgaactttggagccggtcgacctggacttgaatctcagctgctccactgactgaggtaggggacaatgaatggacaagttcctccctctgcctgagtctttgtttggaaataggggataatagttgcagctttcacacagggatgttgtgaggattagtggagctaaaacaggcaaaatgctaataactgtgtctacatggtaggaagagctcaattgttaaactcttactgctgtcatttgggtacagtgtatgtgtgagaaaaataatttgaaaagtgagacccctgccctctagggcctgtgaggtgacatcacagcagggcccagtggggaattgagaggctgctgtgcccagccctgtggttctggggtcagctccatggcctgagaagggatcaggacaggtaacttgtctgggagctgtgagcagggttctcccaggctgcaccaggaaaggccctccaatcctgcctgtcttgggaaggggaaagaaattatccatgggaaatttaagagaaccaaaggaggttgtagtacctgttatgggctgaatgtgtcccacaaaatgcatgtgttgaagctctaatccccagcacctctgaacgttacagtttgggagacagggtctttaagaagtaatttagttaaatgaggtcattggggtgggccttaatacaacaagactgatattctcataagaagaggagatgaggacacagacacacacagaggaagatcatgtgtttaagacacagagagaaaatggccctgtataagccaaggagagagacttcagtagaaactaaccctgctgacaccttgatcttggacttcagcctccttaactgcaaggaagtaaatatctgtagtttcagccacccagcctgcagttctttgttatggaagccctaggaaaggaatataggacccagtaagcagcaaatgtggaacttcttaaagaggaagaggccacagagaaatgggtggtaagaatcaggtcacaggggagggaggagcatgggggaacagaggacaaagtgaggagcacccttagggaggatggtggctgaacactcccaggatacaccacaccactgccctactcaagtgagcactattacagacttcacatcctcagtttggtgaagagagagggctgggcctagagccacataaccctgttagggtgtctctgagcttactctgtggacttgggcatgtcacttggccctagggcctcaggactggtgaggatttagataatgattctt

SEQ ID NO: 617 - DNA, 1324 bp, Homo sapiens
cacggtttgtgttatttcccatgatgactccaaacgcacccgagtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgtctccgtgtgcaggtcccccgggcctctgcgtctctgtgtgcaggctcaagtttgccaacgtccatgcacgtctcagcctctcagcctggactggacaactgggcttcgggaattcatttaaattctacccgctacacgccttccctggattcagggcggcgtccagtgcattcatcacgcgtgtgctgccgtgaaggtgcggggaccccccccaaaaggcttccttccctgtcctgcgtcctgcccacaaggcggtgctgctggcaccaggcctgacctggcgctgccagtgctccactgttttgagttattgaccaacaattcactctcgggtcccgaggggaactggcctgaggccactcaagcagaggctcaatgaggaaagataaatatttcatggtctgggtcggtgagagagggaaatcaatagcgcatcccatcctcagtacggcgcaggcctcccacccaaggcagcgagttgcatcctccgtgccgcgcgggccctcccacccgaggcagcgagttgcacttccgggcttgttctcttcctccctttaaggcaaggctgcaaactgccaggccgatggcccgtgctgggagcaggcaggtgtcctgactccgcctccagccggtgaatcagagccctgagattcaccaagggccccctgcccgggtcgtggaggcagagcctggggctgggagaggcccttcaggacccctctgtgggagccggacgcaggcctggggatgttggaggtgggagcgcttccaggccccttgtgtaggaccagaggctgctccgaccctgctcggggctctggagacagaagaacggcatgagtgtttcacaaatggtgca

SEQ ID NO: 618 - DNA, 5797 bp, Homo sapiens
cacggtttgtgttatttcccatgatgactccaaacgcacccgagtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgtctccgtgtgcaggtcccccgggcctctgcgtctctgtgtgcaggctcaagtttgccaacgtccatgcacgtctcagcctctcagcctggactggacaactgggcttcgggaattcatttaaattctacccgctacacgccttccctggattcagggcggcgtccagtgcattcatcacgcgtgtgctgccgtgaaggtgcggggaccccccccaaaaggcttccttccctgtcctgcgtcctgcccacaaggcggtgctgctggcaccaggcctgacctggcgctgccagtgctccactgttttgagttattgaccaacaattcactctcgggtcccgaggggaactggcctgaggccactcaagcagaggctcaatgaggaaagataaatatttcatggtctgggtcggtgagagagggaaatcaatagcgcatcccatcctcagtacggcgcaggcctcccacccaaggcagcgagttgcatcctccgtgccgcgcgggccctcccacccgaggcagcgagttgcacttccgggcttgttctcttcctccctttaaggcaaggctgcaaactgccaggccgatggcccgtgctgggagcaggcaggtgtcctgactccgcctccagccggtgaatcagagccctgagattcaccaagggccccctgcccgggtcgtggaggcagagcctggggctgggagaggcccttcaggacccctctgtgggagccggacgcaggcctggggatgttggaggtgggagcgcttccaggccccttgtgtaggaccagaggctgctccgaccctgctcggggctctggagacagaagaacggcatgagtgtttcacaaatggtgcagacagttcacaggtcaagacaggggacaaaagtgaccacttttagttaaaaacaggtgactccgtcccaggacaagcacgatgctgtgttaggtcccgttagtccccttggaaagctgtcggctttccctggagaggacctcgttctgtccacgccactgccctgcgagcgagagggagtgcgagcggggcgtccacgcgctcccatgggggacctggggctgcttcccgcttcccgattttccttcagcgctgctcgtggcgtgccctttctcccgtggcgcagtcaccagcaggacgtgtgtcccgctcacgctttgggaaacacggccttgtagcaggagctgctctcggggttcagcatcgggggtggcagagcccagtgcctgctggggcattgccaggcatcgtggagctggacccagagccaggggtcccagctgctgctcctcaaggaccctgtggctcaggaaagccctcccattgctaacgtgtcacccgaagggcttggggacctccacgcaggatgggcttcaaaagtcagctcaggcggtgccctggcctcgggtgcgcggggagaccactggcctccctcatgccggctccctgctgactgtctcgtgagctcctggcagcccttctagaatgttctggcgtggctccctgctcacgtttctaaagcaactatcagcccatcctcaattaccgtgtctccaggaccacagacgacctggagcagcaagagtcagtgctggggccgggcgcggtggctcacgcctgtaatcccaacactttgggaggccgaggcaggcagatcacctgaggtcgggagttcgagaccagcctggccaatatggagaaaccctttctctactaaaaatacaaaattggccgggtgtggtggcgcatgcctgtaatcccagctactcgggaggctgaggcaggagaatcgcttgaacccgggaggtggaggttgcagtaagccgagatcgtgccactgcactccagcctgggcaacaagagtgaactccgtctcaaaaaaaaaaaataaataaagagtcagtgctgggacgagaggcaccggtaacatggccagtgttgcagccggaggcgggcagggctgacctgtccagggaccagcagagctcgggcaggaggtgaccctgagtcgggggagagggggcgtgggagcctggggctgggggaggagggaggatgtcactgtggatgaggctggttcccagcctcaggagccaggcccgggcccctccagctccacctgtgctcacctgggcaggtgatgccccatgctgagcctctgctctctggtccttagggtgggggtgcagttcatgccccatgggctgggtgaaagaataaacccccacccagtgggcacgtgcggcgggcacccagagtgcttgaagtttccttgtgaggctgctgctgactctggggagggacggtgtcgttggagtggggccacctggcttggcccgttgcccttggcagcaggaatacagctgccctgggggctcctctgccacacgggcactcaggggtgctggtcgttgggtccaggcagggtgggggcaagagccactgaggggccctttgtttgcatcttaggtgacgctgcagaggtgagtggccggggcatccagagcttccctgaatgactgggccacgacgatgaaggcgtcagggctgcagcctgctgggcgtgccccagccaagttttcaggacggcctctgcttctccttcggggaaggagcagccctactccctctgatggggctgcctgggagggttggatttgttgtttgtagggaaagactggggcggagagcagggtgctgtggcccctctcgtccctttctggttcctggggctgtccgcacagagcaggtggggacacgctggctggatttcatctggatcagaggagggtgagaggatggtctcctggtggggagtgcagagcctcagctctggagtgtggagaaggatccagcttgttgggtggtgtatggtcagaagtggggacctcggggcctcagatctggcctctgatcccaactctgttcccctcggagccacccttccctcatccatcaggagccagtagcagccccaggacagctgccgtgggataaataaaaggagccgccttcaggagctgcctgccgagtgtccacagaacgtagcgtcttcccagcactcagcgggtcctgatgggcctccttcccaccgccctcttccgagtgtggggagctcaacccctgacttggggtcccgggacattcagttttgtgtgtgatcagggaggcagcgcctgacccacagaaagcacctgctactggtggggtctcagatctgtgcacacctgtgtcccgggctcctcactgtccgggtggtcacactgtccctgcgctgctggacttgggggcttgggtgcagccagccttgtgctcctcagcctccctggtacaggaggactgtccatctgcctggcaggggcaaggccgtcttcagcggagagacctggaggccacgtggtctgctcagaagtacctgcatgcagtttgatgccctgctgcagcaatcttgaaattcttagtaattttatctttgaatgctcgctttgtaagtgcaatctaaggatggtggcgtgagcatgactgaaggaagctggagatggtcagggtgcgagtccactgcggagccagtaggtgccagtggttcgagaggccacgctttcccttgactcagagctggccccaagtgcagaaaggaggtggtgttgctctcagatgcccacacaaccaaggacacatcccccccgtctccctgggactcccatgtgagctggccacctgcactgcagatgacgatgtggaaggagagagaaagacaggagaccgcggcttttcctttcagtccttcgtacccaacagcaactgagagggcgtcccggcagggtatgaatggccagcaggacgctgaggctgcgtggcgtttccaccgtgctgcaggaacaagatgcacatcgtgcaggagccgcagagcacgcgtgcagaggtttcggtggctttgccccgcagctaacgtgtgcgtgtgtgccttgacttatatttgcattacttagaatgacattcaatagcaaatgaaagacagccggcaagtcaatagagagaatgcggaaggaaggagaaggctttgtttgtggctctgagggcacttttcctcctgcatttgcattttgcactgtgcagatttgcaccgtgcagccacccgggcctcctcgggtctggggctccatttccagcacccccacccagcgctgtgggcccctcccccacgcacctcccccactttggtggtgacagttggttgtggaggaacaatcgtcagtgatgggtgaactagctgtgtttcacgtggcctcctcatcactctgccaagcccctggggcaggcacattttggctgccatcgactctagaatgttctctggtgtctccagggggtgtgcagagctggtccctcccagcgaggagctctgctcacaggttcacaccccctgccctgttctccaagatgggaatgtctgatgagagccccagagaagaatcagccgctgggggtcggggaggtgttggactctcttgaaacaaaggaggcccaagcctggggtcacggggctgggggtgggggtggggtgggagggagtgggcagtgacctgagaacaggaagggaggtggaggtcttgggtcacgggtgatggatgatggaggaacaggcccaggaggccctgcttgctgggggcttctttcctcttgcgtagtcaccctgtggggggctctcaaactcacagagtttggccgtagggaagtgcaggggtggcctgggaggctgcaggctctgggacagcctggctcacacaggagatgggatggcgctgagaggagaccccggggcgcccagcgtctcaggctataaggagcagccactcattgtgacacccgatggtgaaatgctgcattattatttatggtgttgaataatcacagcacaatcattgcaggccacagggcagaaagtgctaatgtagtttaaaaacagtacatttgaatctggacactggcaagaaaataggcaaaataaatacttttgtccacccctccctaccctcttttggtgacttggggtggcctgggtcggtgctcagcccagggtcccgcggccagagccaaccatggcgcgcctggtctcctccagataaacgcgcgcccacgtctctgctgggctttggaattagctcaatactcattcagacgcagagtgcgtgtgccctgccaggacagacgtcattgctgtgcggtgcttgagtgccatcaataagccacagaagagaaatccggaaacaagggacgcgcagcgtgattccgtgccacggcgtcaggagcggca

SEQ ID NO: 619 - DNA, 922 bp, Homo sapiens
ccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctgtggggacaatgacgctgtggacagtgaggacgctgtgggggcggtgaggacactgtggagtgaggacactgggggcagtgaggacgctgtggacagtgagggcgctgtgggggcggtgaggacgctgtaggggcggtgaggacgctgtgggggcggtgaaggcgctgtggggatggtgaggacgctatccggggcggtgaggacgctgtggacggtgagaacgctgtggggacactgaggatgctgtgaggacgctgtgggggcagtgaggacgctgtggaccgtgaggacgctgtggggatggcgaagactctgtgggggcggtgaggactctgtggacggtgaggacgctgttggggcagtgaggacgctgtggaccgtgaggactctgtgggggcggtgaggactctgtggacgcggtgaggacgctgtgggggcggtgaggacgctgtggacagtgaggaggctgtggagacaatggggacgctgtagacaggacgctgtggaggcggtgagggcgctgtgggggcggtgaggacgctgtggaca

SEQ ID NO: 620 - DNA, 3435 bp, Homo sapiens
ccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctgtggggacaatgacgctgtggacagtgaggacgctgtgggggcggtgaggacactgtggagtgaggacactgggggcagtgaggacgctgtggacagtgagggcgctgtgggggcggtgaggacgctgtaggggcggtgaggacgctgtgggggcggtgaaggcgctgtggggatggtgaggacgctatccggggcggtgaggacgctgtggacggtgagaacgctgtggggacactgaggatgctgtgaggacgctgtgggggcagtgaggacgctgtggaccgtgaggacgctgtggggatggcgaagactctgtgggggcggtgaggactctgtggacggtgaggacgctgttggggcagtgaggacgctgtggaccgtgaggactctgtgggggcggtgaggactctgtggacgcggtgaggacgctgtgggggcggtgaggacgctgtggacagtgaggaggctgtggagacaatggggacgctgtagacaggacgctgtggaggcggtgagggcgctgtgggggcggtgaggacgctgtggacactgacgacgctggaggtaacaatgaggacattggggacaatgagtacactgtgggggcggtgagaacgctgtggacactgaggacgctgtgggggcggtgagggcgctgtggacgcggtgaggacgctgtgggggcggtgaggacgctgtggggaccgtgaggacgctgtcggggcggtgaggacgctgtggacgcggtgaggacgctgtggggacggtgaggacgctgtggggaccgtgaggacgctgtcggggccgtgaggacgctgtggacgcggcgagggagctgtcagggcggtgaggacgctgtggacgcggtgaggacgctgtggacgcggcgagggagctgtcggggcggtgaggacgctgtggacgcggtgagggcgctgtggggacggtgaggacgctgtggacgctgtcggggcagtgaggacgctgcggacgttgaggacgctgtgggggcgatgaggacgctgtcggggcggtgaggacgctgtcggggcggtgaggacgctgtggacgcggtgaggacgctgtggggacggtgaggacgctgtggggaccgtgaggacgctgtcggggccgtgaggacgctgtcggggcggtgaggacgctgtcgggacggtgagggcgctgtggacgcggtgagggcgctgtgggggcggtgaggacgctgtggacgcgatgaggacgctgtggacgctgtgaggacgctgtgggggcggtgaggacgctgtggacgcggtgaggacgctgtggacgccgtgaggacgctgtggggacggtgaggacgctgtggacgcggtgaggacgctgtggacgcggcgagggagctgtcagggcggtgaggacgctgtggacgcggtgaggacgctgtggacgcggcgagggagctgtcggggcggtgaggacgctgtggacgcggtgaggacactgtggggacggtgaggacgctgtggacgcggtgaggacgctgtggacgccgtgaggacgctgtgggggcggtgaggacgctgtcggggcggtgaggacgctgtgggggcggtgagggcgctgtggacgcggcgagggcgctgtcggggcggtgaggacgctgtggacgccgtgaggacgctgtgggggcggtgaggacgctgtcggggcggtgaggacgctgtcggggcggtgagggcgctgtgggggcggtgaggacgctgtcggggcggtgagggcgctgcggacgttgaggacgctgtggacgcagtgaggacactgtggggacagtgaggacgctgtggacgccgtgaggacgctgtcggggtggtgaggacgctgtgggggcggtgaggacgctgtcggggctgtgagggcgctgtggacgcggtgagggcgctgtggacgcggtgaggacgctgtgggggcggtgaggacgctgcggacattaaggacgctgtggacgcggtgacgacactgtggggacggtgaggacgctgtggacgccgtgaggacgctgtcggggcggtgaggacgctgtcggggaggtgaggacgctgtgggggcggtgaggacgctgtgggggcggtgagggcgctgcggacgttgaggacgctgtggacgcggtgaggacactgtggggacagtgaggacgctgtggacgccgtgaggacactgtcggggtggtgaggacgctgtggacgcggtgaggacgctgtcggggctgtgaggacgctgtgggggcggtgaggacgctgtgggggcggtgaggacgctgtcggggcggtgaggacgctctcggggcggtgagggcgctgtggacccgatgagggcgctgtgggggcggtgaggacgctgtggacgcggtgagggcgctgtaggggcgatgaggaggctgtggacgccgtgaggacgctgtggacgcggtgaggacgctgtgggggcggtgaggacgctgtgggggcggtgaagatgctgtggacgcggtgagggcgctgtgggggcggtgaggacgctgcagatgttgacgctgtggatgctgtgggggtggcgagggctctttggacgcggtgaggacgctgtgggggcggtgaggacgctgcagatgttgacgctgtggatgctgtgggggtggcgagggctccgtggacgcggtgagtacgctgtggacagtgagggtgctgtggggacagtgaggatgctctggggggcagtgagggcgctgcgcggacagtgagggtgctgtgggggcagtgaggacacggtagacagtgaggacgctgtgggggcagtgaggatgctttgggggtggtgagaacactctaggcagtgaggacagtcccagcagtgtgtctcgtcctctgagcatgttcaggggctggttcttgtggacagtgccggccttgaggacaccaagagcatttcaagggttgggtttcctgatgcagggactgcggcgttggcagcattcagttcactaggggagcgttggggcaggtgaccagggctggttcaggtctgttgctccatccgggatccct

SEQ ID NO: 621 - DNA, 117792996 bp, Homo sapiens (residues 1-1,682,758 of 117,792,996)
  misc_feature (358797)..(383796): n is a, c, g, or t
  misc_feature (12480561)..(12530560): n is a, c, g, or t
  misc_feature (13211533)..(13391532): n is a, c, g, or t
  misc_feature (15763259)..(15813258): n is a, c, g, or t
  misc_feature (21949357)..(24949356): n is a, c, g, or t
  misc_feature (39920968)..(39940967): n is a, c, g, or t
  misc_feature (76754544)..(76824543): n is a, c, g, or t
  misc_feature (78946938)..(78966937): n is a, c, g, or t
  misc_feature (106685630)..(106715629): n is a, c, g, or t
  misc_feature (112143340)..(112183339): n is a, c, g, or t
cagtcagaagagagtgcctctaggatgagtaatggcagcaaactgatcattttcctcagatcttgacatattggctaagtagttgtctggtgtttaaaagctgctgatgttgcttatggctgtggcttattgtagaactagacataatgtcctggatacttcactggaatgcacatctgaggacttcactcaaggcaggagaagccatagtaggtgggtggcctgtggcgggtgagtccctctgtgtactcaggtggtcaccttacagtttatgcagtcatcaacactaacggtcactgtgaccctgtaaggacccgggcttctgggctccttcagactctgtttcatgtctgaggtggagtttgaaggttgaccttggatgagcccctgtttcaagctctctgcagagtcaaggggcatgggagagtcagcaggagtgaccaccatccctttaagaattgtgttcagctgtgcttgtgggtttcacaggaagcatgggggccacagccagcatagcatcaggctaatgtggcaccctgccagatctcccttccacatgtgcaaggtatcctacactcaggggagacagggaggaagagagaatcgctgccattgggaaggcatgagctcacccatatttaggccttttgtgcatttctaacagtcaggagggaaaggtgaggaagtagtccctctggcctgtgccctgtggacaggacagcattggtggccagtgccctattgggattgggaaaactaactcccgagtgggcaagggcagaggctggagtgactgtggcttccaacttgtccagtgatcacaagcagtgtcagggcaggccggggtcaaacttgtgtcaagactgcaggaaacttcatgtgtgaggaaagatgagcaccagagttgaggctgggggcaggggacttggaggttaatggtggcttggtcttggcatgaacacaaggcctggttaccagactggcctcccaaagagaacatcctttgcaacagaagcattttgaaggcccaggtctcctggtccttgtatgtgacagatattgcacatgtgttctgagggagatggcaagattctttacaaaaggtctttggaaccccaaaataggattcaagtaaaagaaaatatcaaatacactatttcccgaatgcacagattacacactgccagcccacatgcctaatctggacaacaggtttgctaatcctacatagacattactagtatccatttttacagatgtggacaccaaggttcagagatgttaattagctcactcagtcacatgacaagtatgtatagcatagtgggggcaagagcccagccttccttacctattgttttgctctttcctctactctatcctgagaaatgggccttgagaaaaaaattaatgttttcttctagaaaacagaaactagtcttcaatactaagatgttagggtctattggatatccagcaaagcatctaaataacttactctcaattaccttcatttctgttttatttggtgaaggctggataagctaggattaaaaagactgattgtatgaaactgcttctcaactgaggtgtttttgagaactgcctctgttcactgtcatggtcttaaaggtgattatgtgtcatcagaagtttctgttagctgaagtctgtatcaaagagactgttcttcgaagtactagtactgagggtactgcctttttcctcaaagctgtgaaattgtcttttgtcatcaaagacaagaactctggtttttatctggtggcagagcctttgggaagcatcagagtaaactgaaaaaattatctggagatgacaggttttaatttaacagctcatcaataataacaataaacaaacctaattattttaacacaatgctatccataaagtgaaagaacaaatatttgtgacattccaggaattccatggaaaaccacaaagagtgttatagatgccaaagatgctgtgaaagttttattctttatatcatttttcatagagaatttaatttgggaatgtaaaattttaaagttgactagagttttatgcacttgagatgggcagaactcaacagtaggtgtgtgggtagaggaaacatccagactaggtgtaaactcgttgggaagtccataggtaggtggcacaggtagcctaaaggaggtattggtaattatgcatggttagagctagtctaagagagacatagcaggaagtgcatggtttgaggaattctccagccttgggaaagatactgcaagaaatgtatgagtagaaatattatatagcttaggggaaaattcagcaggagatgcacatttggaggaaggagtcagtctatgggaggccttgatgagaaatccatgggtcaagtgagcacccagcccaaagaagaacattagaagagatgcatgggtggagaaaacatccagcttagtaaaaataaaaaaaaacccaaaaaacaaaacaaacaacacctcagcacgaagtgtataaacttagatgagagttgtgcatttgatgctataggttgaggttgcagcatgcctaggagagaaattatcagatggtatgtcggtggagggagaatctatggtggaaaaggtcttggcagagagtgcattattggagggcacagcaaatctagaggaatttctggaagaaggtttattgttgaaaggggcatccagcctagaaaaggactctgaagcagttgcattagtggaaagtgcatacagtctaggaaaaaggtttataggtggaggcaaaaggtttatagatggagaatgtagccagtttaagtaagacataactggtggcacatggagagagggggtatcaaagatgtggggaagaatgtgcaagagtatcatcggtatatggaacattcagcctagataagcacccagaagacgttttatgagaaaggatggagtcattctagggagtcttcttaggaggttattgggtagaggtagcaatcaacctaaaagaggactcaaaagggtgtacatggatggataatgcagctagcataggggagggattcagcaagtcgtgaatgggtcaagatggcatccagcccatgagaagagtaagcaggaggtatgtggtgatgggagtatacagcctagaagaaaaacacacaggaggtgcatggatggaggatgcaaccagcctatagggggacccaatatcaggttcagtagtggtgagtacagctggctttagggaaagcccagcagtagctgcaggaatggaggaagcattcacaggaaaggaagaactttcagcaggtaaatattggatgaaaaattataaatctatcctaagagaacacatagtagaaggatcatccagtgaagggaggaacctacagcaggtgcacggttgaagcaagtggaaagcctggggaatgacatgagaagtagtggagggatgagtggagggatgcagccaaaacaggaaaggaattagctgaaggggcaaagattaatgatacaagcctgctggatgatctgagagaaagtgaatggctagagggagaagtcagcctgtggcattgcatggcaagatgtgtacagatggaagaggaggaagtcagcctgtggcattacatggcaagaggtgtatagatggaaagtgcagaaaggctatgagaggccacccagactgcttatggctggaggattcatcaagtctaggggtggacttggcaagagataatggatgaagtgtacatcaagtctagaaaagaacatagtagaaagtggataaatgaagtttgcagtgggcctagggtgggatctggcaggaagttcaggggtggagttaacacccagtattaggtaagacttgggaaatgggggagtaatgggtaatacagacagcttgaagaggaaatggcatagagtgcatagattgagagtatagccagtttaggtgaataatttgcaaaagttgcattcatttagagagcatccagactaaagggaagcttagcagaaggtgcatgggagggtaggggaggatgtcacagaaagtgtatggccagcaacaacatcctttttctctctctgcttctccttgtgagtgaccctctgtggccctatgtgacacaccacgcctcttgtcctctggggaactgtgagtaataaacacttctttcaaaggcagttatcttcttgtctatcatcttgccatacctaattataataaaacatatctcgagtacatttttaaacaattggtgcattgagcagggtagtttggtgattggtgaggatgacatgcctctagactgctcttggcttactaactgaatccaacagagagtaaatactgcctggaatggcactgctggcttgtattttagcagctgccattgtgttgtgactgtcaggtactgctctgattctccagtctaaattatggtagagttcaaaaagctgagtcgtccctgagcaactgtccttagagtgctgtagtctgggtaaagaagtctccagttgacttcttatgtatttacaatgtgtccagaagtgactatggtaactggctattgtactatgtgaaggttgtccagaagggacaatagtgtgaaatagtgtatcacaagaccaagagctttgattttagaaacaagcataagaacaaaccaggcagtgccacagttgccctcatggaactagactccaaacctggggagactgactgggacaccgtagaacaggagatgccacctataggcaggaccacaacaccaaaacactgccacaagtagtaaacaaccaaagaataaaaaccactggaaagaggagcgaataggaaaacaaggcagagactgagttgggaccttttcctaatatgcagttaccaccttttgagacactataggactctaaaacatcatccccagacaaacatatgtattagagacatgggcatctctcatgaaaaaaaaaattaaaatgggccagcctgcttattataaactccaacaaccaaaaaacctgctagatacctttgaaactcatgcagcaggggaagttcccctctctttacttcaatttggtccaaaatagtggataggagatgccccactgagacgaagaaaggcacttccagttcctagttaatgggttcctaatatcatgtcctgaccttcaacaatggcagccacctaactccctcctgaaggagacagcagctccccaaagcttgtctcactgcctggggaaaatcaccgacatactaccaaagttttcattgaagctcaaagaatagccaacattttctggtccttttaggtacagggatacagataacagttactctgggtatcccatctcttttcaaatatatatgtatatatatacatatatatttgcaacctatttaaaattcagggcatattgggtcaccccattaagggcatatgggttccacttgatgctaaaatgggatctcttagctaaattccttgtgatattccctctgtctctggcccatctagtcataagcatgaacaccaaacacgttagggccacctcttaaattggaacatgccaaaatccgcaccacttgctataagacatgctcaaggagagatcatagtccctctgcctccccttaaaattgtcaagaagactcaacacaagctatgacaatgtgcagcttgactcaggcctattattttaatcttttaaaagatagaattgtggttcctatcatctctctttttaattgcagtatctgatcaaagcaaaaggcagacaaacaagaatggcctaagtatagattactgccacctcaatgcatttgttctgtccatggaggcaccttttcctaacattattgaagttattagtatcagggttcacctagtgatttacttgtggtaacacatctagtcaatattttctactcaacatccattgccaaagattcacagccacgttatgccttctcctttgaggacacacaatatacattcacttgattatctatagactacctcaatagcctggccatagcacatgactctggaggaaggacttataattcatcaatttacagcattcccacttttggcactatgtagatgacatcttacctaggagaccttctcaagataatgttacacagggcttacatactcttacacatcacctccaagataggaaatatacatgaataaaatacagggacctgcaaagatgataaaattattgtatatcttgtggtcatcagagggttcttccattcctggttcagtaaaacacgaattactcaccctcttcatggtaccacagacacttaaacaggcccaagatctcctgagcctctttacctttcaagaccaacacatctcacatgtattcagtatacttggacccacatatgaggtcatatgcaagtcaaacttcctccattaaggcctctcacaacaaatcttaatagtcagataactttacagtaggcattgaccttggttcccttgggatccaacttttaaatcaaggctttggctacaaaggactatgcctcttggagcttctgcatcaggcatggttttaagtggttgcccatgggtttttggaataagtaacttcctcaaatggcagatattcacctctcaaacaacaaattctgtcccttctggaaactgaggccctaattggctcaattctatttggcatccagacacaaatccttatcatgccttaagtcaagactccatgccaagaggctaggcatggccacagaatcctctttggttaagtggaaatagtaatttagagattcagttaagcctgatgccacaggactttccaaacttctgaagaattggcttcccatgtgctcagtcccttggccatgcctattaaggaggtggaggtatacaccatgtcattcctagtagtgatctagggagctccttgagatcaaatgtctggcataggaagtcagtatgcctcaccaatggcagggccaccatcccacatggtgggaatcagtagtgagtggtggcataccacactgcttctggttcctctatcacaaggaatagacatgagggttggcccaattggcagagtttgaggctgtctacctgatttttcaggatgccctgcattgcaaattgcctgagatttgtttgttgactgattcccgcatggtcgtcattgggtcagaaaaattgaagcaagataattttaccattcagggaaggtctttgtgggctatctcatatggcagacattacttcatcccccatacttattcttgttttgcacatctctgcacatatcaaatcaaataaatcagaatcacattataattctatcacagacagcttagcaagaaataaattcactgtactaatacatggatctgcctctcccagataatctccattgtctgcttttgttcatggccagataagcatatgaaccctagggacacctagggtcccaggctactttgggaacaaaggaaagacttcctttataaggtttccagacatcaaagttgcccaaattagctgtaatctgtgtacctttaccaaacactggcctttatcatctgtagatacaatttctcggggcatgaggccatatagtcagtgacaatttgattctattgggcctctgccactctctgctggtgccacctgatatgcttttatcatgaattacacatatatgggtttgctgttagccttccactccgggcattctaattctgagtctactatttaggaccttactaggttggtccttactaggttggttccttgatcatccttccagttcctgcagacttgcatccctgacatgtccttaacttggctggctgtactctcccactctgcacctcctgccaagtattcttaggctatctgcaccatccacccacgcacctatttatgggcctttgatgcttcctccacccatgcatttcctgcatattcctccgacaaggctgtataatgcttttacttctgcacctcctgccatgttttcccttagacttgctatattctctgcttatgaatctcttgccaggtcctctctgagagtggctgcatcctgcacaaacatacctacttctgaatcctatcctaggctgaataccccttccaccctttcacttcatgtcagtatttttctagacttgttgtactctccaacaatccactttgtgccatgtcttccctgaagttggctgcgccctcccataattactcaatcctgtatacccaccacccccaccccaggatgaattctgaggtagaatgtatgccattcacatccgtgcacatcctgccagattttctcctaggatgtctgcacacttcactcacgttccttttactgaatcttcccctatgcatggtactccttccaccattcaaccgcctggatgtcctcacatctgcttactgcatcctgcatccacacacctcctgccaagtcttcccttacactggcagcatcctccactcatgaacttcaggccaggttcttccatatgatggctgcattgtcaacaatgtacctcttctcaagtcctcccttagactagacattaccttttcccttgcactgcatactagtcattctctaggctccctgcaccctccacatatacacattctgctgcagatagcgttatgttgataatctcaccacccacacatgttctgccatgccctcttcactaggctagatgctccctcctcccatgcacatcatgctgaattatcaaatttggctccattaccaacccttgaaattaacatttaaccctccaatagtttagatacaaagaatatccttgcattttttgctagaaaccctcctactccagcttcactctctgttgatgcacttcctacaggtttctctgtgaggctagcttcacatttcctcatgcaaatccagcaatgtccaactgacaatgcaattactgctagttagttcccagactggctacaccctccgaaccatgcacttcttggtgcaccaaacttcaggctggcctcactcttaagcttcctgatgggtcctccccgaggctggtgcatgctgtagtcataattttcctgactactctccctttgacttgctgaaaatgccacaaatgcacttaggactgagtactcccttagcctggatctccctcactcacagaattcttgccatgtccttgcttaggctttaccctctcctaaaccccctaaacctcctatggggttcccccctaggctgccttttcctacctcagttgcacctcctgagtgccttactatagtgtgtacatatgcacggagtgcacacatacatatagcacctgatgggacctccactagcctggatgttccctctacatgccatatcctcctttatactgcgagtttcctacaccctttcattccagccagaatgtatttattataaactcataaacctactccaatgttattccataagctttctgtaccctccacctatatttttcctaacaagttataccattggcaatccaccctctccacccaaatttctaccaaatcatccccttgaccagattctctttcctcccacaaacatcctgccatgtcctaaccaaggctggatgtaaccttgagccatccactattctccgattcctcctgtatgctagaaatcttctctaatgatgttctctccaaccattcatataacactgagtcctctcctaggttggctcatcctcttcagataccatcttcccaagtctccactaggttgcatggcccctccacccacatacttcatgctgattctaaccctaggcttaatgctcccacctcccatgcatttcttgatgagttcttcctaggtttgctgcaccatctttcatatactcaatgctgagtcctccattattctggatccttcctccaccaatgtcatgccaaaatctaggctgattactctttctactaatgcatttattccaccacacaccacccatgcaatttcctccaggttctcaactatactggatgtatccttcacttctgcacttcatgtggaatattttcctgatctggctccaacatgcacatcttgccatgttctcccttatgctggctgtatcattctcactgtaccttcttcctactcctttcttatgctagatagacactccaaccatacgcttcctgaacgattatttcttagcctggctgcactatgcacccacgcacttcctactgattcctgctttacgctggctgcacctttcacccaagcaatactgtcacttcctacactagaaattctctgcactgcacaaatgtacttcctatagagctcaaacctaggctggctggagtctttgataatgtactttcccctagtcttcctctaagctggttactacctccacatatgtaccttgaatatcctgcctagtcctctcctagactagccatacccttcatccatacacttcttgttccgggcctaatctgattgttctctcatgcaccctataacaagtcctacctgtgctggatgctccctctagcaatgtatatcctgccatgtcctaacctatgcacctccccctgagccttctactagactggatgctcctttcactcatacacttcctgcaatatgctctcctaggctagatgttccctccttccttgcacattctagtgaattcttcctaagggtggatgtttctaattcccatgtatattcttctgtatcttctcctagtctgggctcttctgtgcaactagttctgactgctcttcattgctggctgctccaattacccatgtacttactgaattcattcataggctggatgttctctccacccacacacttcttgtcaggtcttgcattgggatacctacatcatttagccatgtaccttctgctatatcattccctagactgactgcaacttccactccacttatgcacattctgcccttcactactctaaacaggggtagtgagttgaatggtgaccctcagaaagatatgtccatgttctaatctccagagtctgtgaatataatcttatttggagaaaatatacttgcagatgtaattattttaaagatccctaagatgagatccttctagattatctgagtgagccctaaatccaatggaaaatatccttataaaagaaaggcagagggagatttgacacagacagaggaagagaagacacatgaaggcagtgtgaccatggagaaagagattggggtgatgcagccaagtaatctgagaagtagtcatagccaccagaagctataagaggcaaggaaacattcaaccctagagattttggagggagcatggccctgccaacacttgatttcagacttctagcatcccaaactatgagataatacatttctgctgttttaagctaacgagtttttggtaatttgtcacagcagcccgaggaaactaatacagaaagcttcattctatactcctgcacctcagcccaagtcctctcctagactagttgatccctccatccttaaacctcctgtcaactgtcacttagggtggctgcagccaccattcatgcatgctgcctgctgaatccttccctagcccctctgcactttcatcttatacacttcccaccaaggcctctgttcagcagggatgccccataacacctgcattgcaagctccacacatatatctgtggattatcccctagactagatgcattttgcatccatgcactctcagtcatagcctctcccagacaggatgctcacttcacttatgcacttcctgctgggttctttgttaagctggctgcatcctgcttccatgcataacctaacacgtcctcccttaggcaggtagcacattccaatcataatacacccctaggatggcttcactcttttcccatatacctcctactggctgtttccctatgctggcagcacattccaccaattaacttcctttaatgtcttgttctaggtttaatgttccctgcactgatgtaccccctacccagtcctccccctgtttggttggacttttaatcaattccttccaggttctccctagactggctcctcataccactccttcactttctgctgggcccttccttatattggtgtactttatgcaccgactgctgtatagataggagtatatcttagagtggctgtttctttacccatgtccctcaggcaaatacttgccctatctaaatgctccctccacttgtcaatatcatggaaaatcctcccattggtagcctgcaccctccacccaggcttctcctgttttgccttacctacactgaaagatccctcaattcaagaacttcctaccgggttatctctaacttagccgctttctccatccatccacccatttccaagctcttctttagaattgatgctctctccacccatgcacattctgcctgccctttctcaggtctacctgtaccctgcatccatgctttccttatagtacctcatttaggcttcttgcttccatagcccaagcacttcttgcaggggccattacatgggtgaccgcaccctgcatctctgcacatctttccatgactttctctatgctgaatgtgacttccatccatccactttccagtggtccttctctaggtctgatgctttctatatgcatgcacttcttgcctggacattccctgatatagctgaaccttaaaaccatgccagggcttctcctaggctggaggcttctttctcccttgaacattctgctaagatctcccctgggttggatattacttccatctatgcaccaagtaacaattgtccttgattctggctgcaacttgcactcatacatctcctgccatgtgattccacaatctggttgaacccttcacccatgcatgttctgcctgattgttatctgagctggtggcatcaggcacacatacacctttttactatatcttttcttatgctggttgcacctggaacctatgcatccttgagctcctgggtgagctgcaccttcacccttgctccgccttccaagtttcccacaaagctggattctccctttccccataaacatcttgccagttcctcctctaagctggctacaacctgtatacatgcattccctcttttgccctcaagttagcttggtgtttgccctacccatgcactacttcctcggtggtgagctaggctgtatggtctctctgccactgcactcatgcggattactcctactagtttggaagtgtcctcaatcatgccccttataggatgtcattccttatgctggctgcacaatcaatgtataaaccccttgccaatacctcctttgggctaaatgctcctttgaatcgtgcaaatatctctctgttctctcctaggctgactacacccagcacacattagtcttatgctgtgtctgctcttagactggtttcattcttgatcaatgcacatatccgagtacatttggctttcaacaaactgcaccactgccctccatgccatgtattttactggattacatctcctgccatacccttctttaggctggctgaaaccaccacaaatgtatcttccatggttcctatcctagactgactacattctgtatccatgcccacctgtcatttatttccctgggcaagatgttatttcttccacctctacacctctggtcagctttactgctaggctggctgtaccatgcaccattgcaactcctgctgagactttatctaggctggctatttcatccactcatacactttctacttattactttcctaggttggctgcaccctgtaccagcgcacctcttagtatatcctactctagactgacttaacctttaactatatactacctgcaagatttgctctataatgaatggcccctcctccaatacatttcctgcacgtcctcatctagccctagtgatttcactcctgcatttcttgccagatcatcccataggctgaatatacctttcacccatgaaagacctgccaagtgtcctctaggttgaattcttcatcctctcatgcctgttctgccaggtcctgccttaggttgtatgctccctccaaccatacacttcttgctgattctcgtcaggctgtttccaacttacataatataaattctactgtttccttccctaggctgactatatcctccaaacatgcacctcctgctattctctcttaggttagatgccccaaacaattatgcatgccctgaatatttctcaccttgggatggaagctccctgaaaccatacccttcctaccatatcctctcatagacaatctgcacattccaccccttaacacccctaccaaatcttacctctggatgctctctctaccagtggattttctactgtgacttcccctgatttggtcatttccccaaccacgatgctcctgttgaatgctccactggctaatgctcccattcccaatgcacttccttccaggtcctctgctaagctaactgcaatctgcatccatacacctcctactatttctcctcctaagaaggctgcattcttaattcttgcactacctttttggtccttttggctgactttaactgcattcctgaagatcctcccatgtcctcccctaggctggttacaccctgcaactgtgcacctcctgccatatcttcccctgggtaggtagtaccttccacctttgcacttcctctgagttttgccctaggctggctgcaccccacacccatgcagccattatcagaggcttctttagatagactctactatctactcaagtaccttttactgagacttcatgtgatagttaactttaatgtcactttgactgggctaaggaattcccatattaaaacttacttctgggtgtgtctgcaaggttttgagatgaatatctgagtcaatgggctcagtaaagcagattgcccttctcagtgtggttggccatcatccaatccattgaagacccaaatagaattgatagattgaagaaggagcaatttgtcccttttcttcctgcctcactgctcaagctggaacatttcacctcatcttttcctgtgctcaggctgggatttacaccatttgctcttctacttctcaggcctttgaacttggattaaaatataccattggctttcctgggtttctagtttgctgatggcagaccataggactccacagcttccataatgacataagccaatttctcataataaatctctctccatacacacacagcatcaccaccaccaccaccaccacacacacacacacacacacacacacacacacaaacacacatacacagagagagagagagagagaaataagtttgtggaaaaaaatgaaattagaagataaaaattctaaaaatgtactatattacttgtcttaaggtccatcaagttcaagacacctttttaaacaatgataccactcatatagttcatccctaaagaacagaggttccaggaaatttaatcatgtcaatgcagtcttttttatggttaactaaagtaaaatctttaaagtttttttttaagataagaaaaccaaaagaagccagaaagagccaaattaggactgtaaggtggatactttataatttcccatcaaaactcacaaaaattgctcttatttggataagaagaacgagcaagagcattgtcgttgtgatggttaatattgagcgtcgacttgattggaggaagggtgcaaggtattgttcctgggtgtgtctgtgagggtgttgcaaaggagattaaaatttgaatcagtgaactgggagaggcagacccacactcaatctggatgggcaacatctaatcaactgccagcatggccagaacaaagcaggcaggagaagatggaagagcagacttgctgagtctttcagccttcatctttctccgacgctggatgcttcctgccctcgaacatcagactcctagttcttcagcttttggactcttggactcacaccagtggtttgtcagggtctcttgggcctttggccacaaactgaaggctgcactgttggcttccctacttttgaggttttgggactcggactgatccaccactggctttcttgctcctcaacttgcagatggcctatagtgggactttaccttgtgatcgtgtgagtcaattctccttaataaattccctctcatatatatatatattctattagttctgtccatctagagaaccctgactaatacagtcatgatggagaaggactctctggtgaagctttctcaggcatttttctgctaaagctttggctaacattctcagagcactcccataataagcaaatgttattattctttggctctccagaaagtcaacatagaaaatgctttcagcatcccagaaaactgttgtaatgacctttgctcttaactggtccacttttgctttgactggaccattttcacttcttcgtagccattgctttaattggctttgtcttcaggatcatactggtaaagccaagtttaatctcttgtaaacattcttggaagaaatgcttcaggatcttgatcccatttgtttaaaatttccactgaaacatttgctcctgtcggcagctgatctgagcacaatggctttagtacccattgagtggaaagtttgctcaactttatttttcagtcataattgtgtaaactgaactaactgagatgtctatggtgtttgactactgttaatgcggttaatcgtcagtactcttcaattagggcatgaacaagattaattttttccttgaaaattgatgcagatcatctgctgctatgagcttcgtcttcaacatcatcttgtctcttcttcttcttaaaactggctatccatctgtaaactgctgatatttggggacattgtttacattttgtgaagcatcagtgatttcaccatgcttccactcatgcttcaacataaatttgatgtttgttcttcctttaattttagcagaattcatgttgctctctggtaggggcccttttcacactgatgccttatccttcttagtacctcaagccagatcttgttcagacatgttacaacaaagtagtgtgaatttattttgttgcaaaaaatgtttgcatttttccatatttcatactttccatgaactttgtgaagatccctcataaatatatatatatatgtatgttctgcttctctgcagaacccaggataatatacctctcactgcttcctaatcacatgtaaatgctgaaagatcctctcttgagctggctgtatactccaattttacaaatccaccagaatcccccataatctgacttaattctctcatgcaatttattccactcctattccaagtctgatgctttctccacccctgtacttcattctgggtccttccccagactggttactttctgcacccatacaaaaactcatgggaccttccctaggctgaattttttttcatgcacttctttctgaatcttatcctgggatgggtgctcccttggttcatgcactttatgcaaattgtcccctagggagtctgatccttatatctctgcacctgatcccatgtgttctttcaggctgaatgcatcctccactctaaaatcttctgtcagatcctacaagaggctttctgtatcctcccccatatatatcctgtgggttttaacctcagatagctgcaacttccacccaggcacttactgccatatcctccactaggctggatgctctcttcactcatgtacttcttcccagatcctcttctgatctggcttatcctgacactgatgcaataccctgttgtatcctcctctagagttgctgcaccctacaatcatggacctctggtcaagtcctcctcttgcctgaatgctactttcacccatgtacttcctggtaagtcttcctggaggctggcttcaaattacactcatgcacctcctgtcaagtcctctcctaggctaaattcttcctcaacctatgaactttctgccaggtcctctgctagtctggatgcaccctgaatttgtatacctcctgaaatatcctccctgaggctggatacattctcaagccatgcactacctgttcatttttacctcaggctagactatctgtccaccaatgcactttctcctggttgctccactaggctcactacacattctacccagggactttgcaagtcctctcctagcctggatgcttccttcactaatgcagctcttctcaaatcctctcttagtacatattttcattccactgatgcattgtctgaaatatcctccctttagttggctgaacataccacacatgtaccacctactaggttttcccctttatggattctttcttagaccatgcatctcctaccaagtccacatctagatggagtgcaacatttcctcatgaacataaatctgtgactttttctagatatactggaatctccaccatgcaccttctgacatttctcaccctcagttggctggatcctctattatgaacatcctgcctggtgttttcttaggctgggtattcctctgacccatgcaactcttgccatgtcccctcctaggctaactacaccctctacttacatacatcctgctaggctagttggaactggtgcaattttacaggaattacccccttgggaagatgacacctctattcatgttcttcctgctaaatactctcctagactggctgcaacctccactaattcactaccacccaagaaaacccttatgttagctgtaccttctaccgatgtacctctttccgggttcttgcctaggctggatggtccctacccccaatcaattttagtgaacacttctcctaggaaggagaattcttctggtgctccttctactgagtcttcactgtgaataggtgcttgcttcaccattgaacatcttgtcatcttttccctgagtctgactgcatctcccacccatacactccctaaacagtgaaaatctaggtaagcagcaactttgttttcacttttattttaagttcaggggtacacgtgaaggtttgttcatggagggttgttgtacagattatttctttacccaggtattaagcccagtacccaatagttatcttttctgctcttctttctcctcccaccctccatcctgaagtagaccccagtgtctgttattttcttctttgtgtttataaattctgatcatttagcttccacttaaaaagtgagaacatgcagtatttggttttctgttcctgcattattttgctaaggataatagcctccggttccacctatgttcccacaaaagacatgatctcattcttttatatgactacatggtgtatatgtaccacagttgttgtttttttaatccaatctgtcatcaatgtgcatctgggttgattccatgtctttgttattgtgaatagtgatgcaatgaacatccgtgtgtatgtgtctgtatggtagaatgacttatattcctctgggtatatactcagtaatgaaattgctgagtcgaatggtaattctgcttttagctttttgaagaatcaccatactattttccacaatgattgaagtaatttacactcccgccagcaatgtacaagagttcccttttttctgcaacctcaccagcatctgtaattttttttactttttaataatagccattctcactggtgggaaatagtatctcattgcggttttgattcacatttatctaatgatcagtgatattgagctctttcatattcttgttggcctcatgtatgtcttctttgaaaaattgctatttatatcctttgtccactttttaatggaattgtttttctcttgtaaatgtgtgtaagttccttacagatgctggatattagacctttgtcaaatgcattctttgcaaatattttctcccatgctgtaggttatctgttgactctgttgatagtttctttttctgtgcagaagctcttcagtttgattagataccactgtcaatttggtgtctttgtcatgaaatctttgcccattcctatgtccaggatggtattttctagattgtcttccaggatttttatagtgttttggttttacatttaagtctttagtacatcttgagttgacttttgcatatggtgtaagaaaagcatccagcttcaatcttttgcatatggctagacagttatcccagcaccatttattgttagggaggcttttccccattgtttatttttgtcagctttgttgaacagcagatggtcataggtcataggtgagtggccttatttctgggctccctattctgttccattggtcttagtgcctgtttttgtactagtaccatgctgttttggttactgtagcactgtagtatagtttgaagttgggtaacatcatgcctccagctattaggattttcttggctaatcaggctatttttggttccatatagatgttaaaataattttttctagttctgtgaagaatgttgtttgtagtttgataggaatagcattgaatctgtacattgctttgggcaacatggccattttaatgatattaattcttcatatctgtattagtccattctcatactgctataaaaaacaatctgagactgagtaacttatgaaggagagaggtttaattgactcacagttctgcaggctgtacagaaaacatggctgggaggcctcaggaaacatacaatcacgacaaaagaacacaggggaggcaagcacgtcttcatatggcagcaaaagcgagagagcagagggggaagtgccacataccatcagatctaaaaactcactcactatcatgagaacagcaagagcaaaatccgcccccatgatccagtcacctcccaccagctccctcccccaacattgggcattacaatttaacatgagatttgggtggggacagagaacataacttataattccacccgtggcccctcccaaagactgtgtccttctcacatttcaaaacataatcatacattcccaacaatctcgcaaagtcttaactcattctagcattaacttaaaaatccaagtccaaagtctcatctgaggcaagccaagtcccttccacctatgagcatgtgagattaaaaacaagatagttacatccaagatactatgggggtacaggcattggggaaatgttcacattccaaaagggagaaattggccaaaataaaggggatataggccccatgcaagtccaaaactcatcaggacagttgttaagtcttaatgctccaaaataatctcttttcactccatgtctcacatccagggcacactgatgcaagaggtgggctctcaaagccttgggcagctccacccctgtggctctgcaggatagagcctccacagctgctttcatgggctggcattgagtgcctacagcttttccaggcccataggacaagctgttagtgggtctaccattctggggtctggaggatggtggccctcttctcacagctccactaggcagtgccccagttggagattctgtgtggggacttcaactttgcatccctctgcactgccctagtagatgttctccatgagggatttgtccctgcagcagacttcttcctgggtacccaggcattttcatacatcctttgaaatctaggtggctcccaaacctcaagtcttgccttccgtatacccacaggcccaataccatgtggaagccaccaaggcttggggcttgcaccctctgaagcaatggccaaagctgcaccttggcccactttagtcattcctgaagttggagcccctgggatgcacggtgccatgtcctggggctgcatagagcaatggggtcctggccctggcccacaaaatcatttttccttcctaggtctccacacctgtgatgagagggactaccacgaagttctctaaaataccctggaggcattttccccattgtcttggctattaacattctgctcttctttatttatgcaaacctctgcagccttgaattcctagccagaatttttttttcttttctactgcatggttgggctgcaaattttctaaacttttatgctcttattcccttttaaacataagttctagtttcaggctatttatttgtttatgaaaattagtgtaggctcacagacctcagtgctcagttcctaggaaaactacatttactcttagcatcaccaaggaactaaggtctagcaagcatcaggttcttggagtctgtgtgctaattaacacacatcagccagcagccagttagcaaatcaaacttttactgcatgcaaggcactgtgagagtttccaccaaggacagtagatctgagaataatcattctgagattctatagagtaaaaatttcctaagaattccttgaatcacagaatggtaagtgatctctaatattttgtccagctctaggttccaccccataattttacagaagagacagacatgcaattaagatgacctgcctggggcccacaacattagatcatttcctcatatagcatgaatttgacaaagttcacagaaaatggaacgtactcacagggtgccatcaaaacaaaaaggctggctcagaatcaggtaagacaaatttgtggcaagataagatcattcatttatatatatggatatatatcaattgttttagtccacatactacatgaacaggtattaataaaatctattcatttgtgtggaaaatttcccaaccatttgctatttaaaggaacccaaataatttgacagttgttgcaaaatatttttaaagtatacttttataggcataagagaatctaatttcaataaatgtgagcacttataatcaaatcagcaaaaagtatttccactgtgtgaaactgctccagttaatcaggtgaatataatttctatatcctcctaggtcaatatagtacattttaatacaatattgtttgggagctttatgttcaagtagtgaggttttatttttttaaaatggcagcttatttgtaaacaaaataaaaatgctaatgatcttttaaagctttcatacatttgttcaaagacttacacatttttaaactttattcaaacttcatcaaaaatggtagataaaacagtttgattgctcagatattagtgtttacaggccataataataatgtgtgctttgtctgtgtagaatctgtctatgcagttggtattcaggcaagaattatagctggaacaacaatggaaatattggaggacccactttggcatttatgtgaagatttcatatcctatccaacatttactttagtgtctaatcaaattccataccctcaaaaagatctgttggaacaaattgataaaattaggtggaaaggaaagtggtatgggactcaaatgcaagtcacttctggtttaattattggctctgctgcttaattcctctgtacctcacgtcctcatcattgaagtggggacaataatctgggcctacctcacaggggaattgaggatattttgatatattagtgtgctttgaagttgactgaaagatatactggatatcataattatataatttctaaatagatttctttaaatccatgctatgttttctttctcagtcaggtcctacagaatgactgttgcagttgatctattattttaatagtaaattttgttattaattccctatgtgttaaacgtgggtaattgtattaagttaatacatatttagggaggaaaagcaggtggatataaatcagtggttcccagcttcagcagatgatagcagtggagggtatccttgagctttttgtaatatttcaaaaagtatattagaaattatacatttacccataatattcctgcttcacaagccaattaagacattgaatttctatgcattttgcctatgtgctctcaattctgtgttatcactgcttgcttatcaacaactgatcaaaagctgtgaatggcagtatgtttttgattaataataaaataagaaagcctattatgtgcaacctattaaatacttggaaacatgggaaaagaataatgaagggattcttgtggtcaaatgttgggaaccacttttataaaggaactaagattatttgaccctctccacaggttgcttacctagtctctaaataatgaaatgtgtgtgtttgtgtgttttggctatattaggctatataacttcaggttagaatttgccttcagtttttttttctgttttagaatataactggcctaatttatttaggtgtatacatgttgctcatacatacacacacatataggattacaaatgtggaaaatgctataatgtcatattctagcattgaactaaatatcaatttctgacacttaaagtagttctgtatataaattcaacatgatgaatcaaggcaataatttctcaaatgctcttttatttctttgtttgtttttatctcgactttttttattttccattttttctagtatgcaaatagtgtaaaattgttttaatgcctggactttgaaacaagtaacaagtgttcgaaagtatataatctaagagcgaatttgccctccttggactaaccacatacaaatatgaatctggctgcaagaacaggatatccaggtaaccagaaagtgggcattgataaaaatatctggtgaagaagcctaggattttgactttttgtcagaggattcctgttgggacagctttaccagaaaagaataatagtggatatgttcatccaaactaagaactttcatgcatcttgcattgttacatagcctgtggaatgaattcattttttctcccttgagtccaggaatgacttccctggaaaaactcaatctatatacagctatgccaaaatgaaggatacctgcctctctgaaactttcactgctgcttctgccattgttcatttgtcagattaaattttattatctcaggatgcaaatttaaaataaagtgtaaatctatgttaatgaaaaaaaaagaaaattagtgtaggcttttagaagcagccaggcgaattcctgaaagctttactgcttagaaacttcttctgccagataccctaaatcatctctctcaagttcaaagttccacagatctctagagcatggtcccaatgccaccagtctctttgctaaagcatagcaagagtgacctttactctagttcccaataagttcctcagatccatctgagaccacctcagcctggacttcatttttcatatctctatcagcattttggtcacaaccattcaacaagtctttaggaagttccaaactttccctcttcttcctgtctcttctgagccctccaaactgttccaacttcagcctgttactcagttccaaagttgctttcacattttcaggtatctttatagcaatgctccacttctctggtaccaattttctgtattagtcgattctcacactgctataaagaactacctgagactgagtaacatatgaaggaaataagtttaattgaaaaaaattttgctgtctgtacaggaagcatggctgggaggcctcaggaaacttacaagcgtggcagaagggcaaaggggaagcaagcatgtcttcacatggaggcaagagagagagtgaaggggaaagtgccacataattttaagacattagatctcctgagaacccactcactattatgagaacagcaagggggacatccacatccatgatccaatcacctcccagcaggtcccctttccaacactgggaattttattcaacataaaatttgggtgggtacacagaaccaaacaataacactatccatgagcatgggatgtttttacatttgtttttgtcttccctgatttctttgagcagtgttttgtatttctcattgcagagatcttttgcctctctagttagctgtattcctaggtattttattcttttcatggcaattgggaatgggattgcctttctgatttgtctttcaacttggctgttgttggtgtataggaattctaataatttttatacgttgattcttgcatcctaacactttgctgaaattatcagcttttgggctgagactatggggttttctagacaccaaatcatgtcttctgcaaacagatatagtttgacttcctctctttctgttcaaatatcttttatttatttatcttgcctgattgttctggataggaatttcaatactatgttgaataggaatggtgagagagggcatccttatcttgtgctggttttcaagaatgcttccagcttttggcccttcagtataatgttgactatggatttgtcccagatggctcttattagtttgaggtatgttccttcaatacttagtttattgagagttttttacatgaagcaatgttgaatttcatcaaaaaccttttcttcatctattgagataatcatgtggtttttatctttagttctgtttatgtgatgaatcacacttactgatttgcatatgttgaaccaaccttgcatcctggggatgaagcctacttgattatggtgaattagctttttgatgtgctgctgcattcagtctgcaagtattttgttgaggatttttgcatggatgttcttcaaggatattggcctaaagttttcttttttttttctgtgcttctgccaggttttagtattaagattatactggcctcatagaatgagtttgggaggagtttatcctcctcagttttttggaataatttcagagtgactgctctgctgagactccacatagttctgtatgtcagacagaaggccctggtggagcaagttcatcttgacctaagggttgcaaagatctgtgggagaagcatgggttctgggggtcacacattcactcaccacttcccttggcaagggaggtacccttggctctgtgtctctcctgggtgggtcgtctttctgccttttccattctccatgggtcaagttgtttccttcattagtcccaatgcaagtacctggatgtttcagttgaaggtgctatatttaatcaccatttctgtttctctctgtgagacccacacacattagctgcttctagtcagccatcttggccacctcccacaactttcatttgtgtaattcctgtcagatattcctttaggctggatacaggttcctttcattaattttcttccagttttttttccctcagctggcagcacaacccatgaacacagttcctgaaagagcttgtcatagggtggatgtgctattcaccgatgcagttactgcctcaccaacaccgctcccaatagctctggtataccctacaatcatgcatttcctgaagattcctccctagacatgttgcatcttccatgcatgcacctcatgattagtccatgctttagcttgatgcttcctctacccatgcagtttattatttgtcctcccctttgctggtgacacccttcacctatgcacaccctgcataagccactggtagactggtttttccctaaacccacggacctggtcctaggtcttcctataggctgaattttccctatgcctatgaaagttgtcccaggacttcttctaggctctttgaattagcctaacttacatattttgtgaaattcttcattatactgtatatttcatccatccatgcacttcctgtggtcatcccctgggctggttggattctgcacccctgtatctcttgccttttcccaataatagtatggatgcacatgtgacccatagaccacctgacaatttttcaccttatctagattcacaattcaccatgcacaagctgctagaacttcctttgggcttgtacactctccataatgtacctccttctaagacctccctttgccaggatgccttctacgttcatctcctgccatatcttcctgtagactggctacagccctagtccaagtatcttatgtgagctatcctctaggcggactgaattttacacccatgtacctgctgccatatcttcctgtagactggctacagccctagtccaagtatcttatgtgagctatcctctaggcggactgaattttacacccatgtacctgctgccatatcttcctattcgcaggatgctctctccacctatgcaagtcctgcagtgttcttcacctaggctgactgctccgcaagccataagctctctgtcaggtcctgtataaactagctacaccctccacccatgtatcagttgctgatccttccttaggctaggtatttcttccacctatgaaactcctgccatgacctctcccagattgtttgcaccatcaacacacatacttactcctaactcctcctttacattgggttctcttgccaaccataaactttctgctgtatcccccccataccctgactgtaacctcaacatatgtactactgccaggtactacactacactgaatattttctcccactacgtatcacctgcctggtcattccctaggcttgattttcaatgctcttatgcacctctaacaggttcctccccttaggctgaaagcttccttaacccccacacatctaaacaaattcttcgctagactgattgcacattccatccatgcacatattgctgaccctagcctacatgctccctctatctatgcccttgtagaaagattctcccctagggtggctctgccctccatctatgcagcacctcctgagttctacccttggctgtgtgctccctccacccatgaacttcctgatgagtcctgcactatattgctgcatactgcatccatgtacctcctataatattaggccctagtcaggatagtttctgtatttttgtaaggttggccacgttttctccttaggtggatataccatcaacggtgcccttattttcaagtactcctacaggccgaatgctcccagcaatggcaaacaatattaataccctatctgaatgatacctcttacccctatcttctgccaagtctttccctaggctagctacacaccccaaaggtgaactccctgcaaggttttatcctaggcttgaagttccctttatcttggacttcatgctaagtactctaacaggaggcctgcaccctggattcacctcctatctctttctcccctacactagattatcctttaaaccttgcacctacttcctagtcttgtctagaatggctgcaccatctactcccacatcttttgccaagtcttcctccagtctggatgctcatagggtttggctgggtccccacccaaatctcaccttgaattgtaataatccccacatgtcaagggtagttccaggtgaagataattgaataataggggcagtttcccccatactgttcttgtggtagtgaataatatctgatggttttatacatgggaatttatacatgggaattcccctgcacaagctgtctcttgtctgctaccatgtaagacttgacttcgtacctcctttgccttccaccatgattgtgaggcctccccagccatgtggaactctgagtaaattaaacctcttttctttataaatcacccagtctcgggtatgtctttgttagcagcgtgagttgcagatgctatatccatcctcactcctattgctgattactctcctagcctgcatgacacctcaacttgcttctgtaccctccctgttttattgctatgcccccaactaccttgtctacactctccatctatgtatctcttgcagatcttcccctatgcttgttgcttcctccaatcaggtaactccagccatactctctcctcggctggctctattctctttttcctccgatgattgaatgcttcctccaccagtgtacctgctgaatattcctccactaagctgaatcttccgttcacccacgcacttacggcttaatcctatttaatctttatgcttccttcactcatgcatctatttccgattattcccttaagctggctggaccttccaccaaaacactgactacagaatcttccccagttttggtgcactttgtatttataaacttcttgctgtctccttctctgcagcctccattcatgcataccttaccatgttatatcctagtctggaagcttcttatacccatgcacttcttgctagatccttctctaaggtagatgtacccttcattcatgtacttcccaccatgtctttgcttaggatgactgcaccctccacctatgcatcccctgtgaggtcttaccctaagatgaataatccttacattcatgcactgctatagactgaatgtttatgtccaccccccaaatacatgttaagttctagcgcccagtgtgatggtatttggaggtgacagttttgaaaggtaattaaatcaggagggtggagctttcataaatggaattaatgctttttaaaacaggccctggagatctctcttggcccttgcaccatgtgaggttatagcaaggagactgctgtctatgaagtaggaagcggacattcactggacactgaatatgctggtgccctgactatgaacttcgtagtctccagaactgtgagaaatatacttatgttgtttataagccacctactttatggcattttgttatagcagcccaaatagactaaaatatgtgtcaaaggccaggtcctcttgctagcttggctaccctccaatcatgcactttctgtaatgttctccattagacttgctgcattctaagctgagcagatgcaggtgccatgctttctgtgtagcctgaagaaccatgagccaattaaacctcttttctttataacttaaccagtctcaggtatttctttatagcaatgcaagcatgacctaaaacagtaagacagaacatgaaaggaaatccatgggttaattgtgcatccagcctctggtaggacgtagtaggaggggcatatcaccagggaatatatcccctagggtaggagttggtaggaggggaaaggggagagaaagcttccagcctggggtaagatgctacagaaagtgcatgaatggagggcacagttagtctaggggagtagtctacagggagtaaatgggtgaagggaacatccatcctaaggaaaatctggtaaagtccttttagtgtacattgcaagcagaataagggaggacccagtggaaaatatatgggcaggaaagtgtaggcagactcgtggctgactgcacttttcaatatgtccactccacccaatatgtccaaccaagaccactaatcacatgtggctcgtcccaccacatgtttattattccttgtagagtgctccagtaggctgactgctacctggaatcatgaatatcctgcttggtcctacactaggctgaaagcaaagtttactaattcaccctcttctgggtcctcccttagttgagtgctttctccaactatgtacctgctagatacaaattgacaacatactccatccatgtaccatttgctgagtctcacctaggtattgtgcttcctgcatccatgcaaatagctgccaagtgctcctctatgcaagattaattttctttccatatactacctgatgagacttcctttaggcttggtatacctcctactcatacacttcatggagatcttttcctagttttttctacttttcctactttttttctacttttcctactttttcctacttttgtagtcttcctgtgccttccactaatacagatcttcccgtgttccccatagactaacgctccctttagacatacacatcttgtcaagtccatccctaggctgtctgtaccctctaataatccatcttctactctgccttccttgagtctcccagacttaagcaatcctcccatctcacagactcaagcaatcctctcacctcagcctctccagtagctgggactacaggtgggtgccaccatgctcagctatttttatttttatttttccagagatgggatttcaacatgttgcccaggctggtcttgaactcctaagcttgagcaatcctaccactgcagcctccaaaaatgctgggattacagggtgagccaccgtgcctggcccctattattttcttataatggatgctcccaccacccatgcacttcctcctgattcttcctaaggctggctgaaactacctggtccagctttagaatggatgcttcctacacttatacacttcctgcaggttatttgcattaggatggaaatccctccagccctgcctctgctgatatgtcctcccatatggtggcacaccctccactgatacatctcctgccaagttctcccttatgtgggatgctgactccgcgtatatacttcctgctggattgtccccagagggtgactgctttctgcatccatgcagctctcacagtcttctccccttagctgaatgctccctccaatcatgtactgcatccaggtcttctaaaaggctgactgaatcccacatatatgcacctcctcctatgtcagccctaggatggctgcattctagaccttgcacttcctacaagatcttccacagtgactgcatactgcaaccctgcattcctcccatgtcttacattaggctggatgcaacatccttccatgcatcacctgcagagtccaccctggtcttcattctccttccagtgatgcatggcctgcaggatcctcccctaggctcactgcacaaatcaatcatgcctctcaagactctccttaaactgaatgctccttccactaaactctgaccacattctcccttaggatagctgaaacttaaagccatgcttctacagcacgttctttcatgagctgcttccattttcacccacacacctcctgtcatattctaccctattcaggatgctctctccacctatgtacgtcctacattgatgtatcttagcatgtatgaaccctccactcatgcatggccctcaggtcttcccctttgctagatgctcataccacacatggtcctgttgtgccctgacctaacccgtctacaacatccttattatcctcctttagccacagcttcccatgggctagatgcatacctcatccacccatgcacttactgcaagatttttctcccaatgttgacagctttatgcacccatgcactaactgcagagtctacctacctgttggctggatgctcccccaactatgcactttctccatgtcttctcctagcctgactgcacactgtacccaagcatctcctaatatgtgcagccctagcttgactgcatacttgactcatgcaactcctgcaagttcttcctctataccgactgcactttcaaacaggtacctcctttcacatcttcacaatttctcacttccatctatacacttccagtagaatctctcctcaaaggttgctgcttcctgtatccatgcacctcttgcagagtcctcatcttggctagatgctctatcctacaatgcatcccatcttaattcttcccttagttttatctatctatctatctatctatctacctatctatctatctacagggtcccactttgtcacccaggctggagtgcagtggcacgatctcagctcactgcagcctcaaactcctgggctcaagcgatccttccacttcagcctcccaagtagctgggactacaggtgtgtgccaccatgcccagctaatttttattttgtagagacagggttttaccatgttgcccaggctggtctcaaactcctgggctaaagcaatctgcctgccttggcctcccaaagtgctgggattacaggcatgaaccactgtgcctgtcctctttccctagttcagctgcatcattcctcccatgcacctcttgctgccaactcctgtaagccagctccacactccactaattcacttcctgcccctcccctgcctgcctcaggctggcttcaatcttaactcatgaatcttctgaggatcaacatttaggctgagtgttctctctagtcttgtctcctgtcctcttcgacactagcaatacccatgagcaatacacctactgccaaattatccactatgctggatagccatgcactaccacaacttttctccttagtctgtatgctgtttccactaatgcatttcctcgcaggtcttcctcctagcctggatgcaccattcacccatacatttttctatcatgtcctccaatacactggatgatctcccatcacttgcatttccttctgagttatccctgcacattccacccaggaactttatgccaggtcataccctaagctggatgttgtcctcactcatgcttctcctgctactcctttatgctggatgcatttgtgacccatgcacctctcccagttatctctgaccttaacccatgagtcacctgccaaattcttccctaagttggctccagctttcacccatgcactttctgtcagatcctatcctagatatgccatgacttcaatctatttactccttaataaggtcaaattaaggaaagatgctttgtctactcaaagatcgtgtagaaggccccagcccccattatcttcatcctgaatgtaccctctactcatgcactccttaccaagcctttctataggatggctgttctatccaatcatgaattgacacaatgatcctctccaagcctgaatacttcttccaatcatgtacctcaagcaatgacttctcctaagttgacacccttgacctatgtatgtggtgtccttccctcagctagaagctccctgtacctatggagtcctgcaattaaaacatacacccctagaatagatactatctccacccttgaacctccagttgtgcagttgactgcatccaccactgatgcatttctggttgaggtttctactatcttgtctgtaccttccagtcctatacctcttgccaagttcttccctaggctgactacatcctccactgatgcatttcctgctgggccgcaccctgtgcttcgtgtaacttccaactatgcaccatgtgctagatctacccataggctggaggatccctccaccaatggacctcatgccaagcactctcataggctgcctgcacacttcatggtacatttcttgccttttcatcccttatactggatgatccttccaactacaaacctagtgccttgtccttacctaagctacatgtttgttttaccatgcacccttgccgaatcttgccaaatcttctactgtcctgggtgtaatctcccctgaaattactcctgggtcctgtcctaggctggatgcattttcatgcccatgtagttcctccaccgatgcaattcatttcaggtcctctcctacccagcatgaaccctcctgaagggtcctaatttaggatcaatgctccttccaaccatgcatgccctccaagttttccactaggaaggctgcaatctcttctcatgcaaatctccctgaacctttctccagtcttgtttctccctccttacacattcctactttagaaacctcttttaggaaggattctagcttcatccatgcagatcctgttggtttctacctttggttggcagaaacatacacacaggtactgcatgataattactcgactatgctggatgtattctcaacagctgcctggccctgcattcttcacctatgcacctccaacaccatcctccattatttgcgatgcactctggagccacgtaacacgtgatacatctactctgggattaatgtttcctccttgcatgcatcttctgccacattctgcactaggctggatgctgtctccacccatgcaactatttttgcaatcttctaggctgactccgctttgcagtgatgaatctggtgacatatttttcatgtctggcagcaccttccacccatgcacctctttcctatgtccacccataggttagttgcatctttcaccaatgcacctcctacctatcctccactagtctgacaacagcctctgtctatacatttcctgatgagttctcccttaggcaggatactccttctacacatacaatttctcccaagtcctgctctagaatagttgtaacttccacacatgaactgcctgtcttatattccaataagctaggtgttacctccacccatgaactaactactgggaccagccactgactggatgacctgtatgcatataggtctctaacctagttcattgaacccattcccctcctaccatgtccttcctaggcttgatctcctttcacttatacacctcctgcctggtcattctctagcctgactgtgtcctgtttttgcacatactaagagacttccctttttctatcttctccatatgcacatgcatttttgcaattcctccctgaggctataccttgcaccaaaacacctccaaatatgtcctctgataatgtgactgcatcctgcacccacacatcatctgctatgcttactctaggctgaatattcatttcaaaatatactttctgccatctgccctcaggcagcgtgctccctatatacatgcacttccttctgcttcctctcccaaatttgcttaaacctccacacatgcactgactgcatgctaggtactctgctaagctagatgttccctccactcatggaccaaatacagggcactgcccaaggttggatctttccaccacacatatatgacctgcagatgtttcgacttagactggaaacttcctcaaccatgagccatgtaacgtgtcctcccctagacttgatgcttcctccacttgtgcacttcttattgggtcttcctctaatttggctgtatccttcacctctgcacctcctgttgtgataccctctacatggttactcctgtcatccatacatttcctgacacatcttacctgagactggctgtaccctacacaggagtgcctcttagtatatcctctcatacaggctgcctgtactctgcatccatgcaacaccagccatatctactctggtttgaatgttccctccttgcatgtaattcctgatgagtctcccctaggctggaggctgcatccacccacactctttctgtcaggtcatcatctagtctgactgcagcttacaacatacccactctaatgtctgtccctagaatggctgcaacctcattcaattcaccactagactggctgcactctgtacctatgcacccccttccagtattccactaggtggaaagtttacttctcccatacaactcctggcagcacacttctaggcctgattttatgtctccctgtgtacttcctgttgtgtcctctcttaggttgcaccctacacatatgcaccacctgcttggctttgtttaggttgaatgctaccttctccatgtagcatgccaggtcctgccctaggctagacagtttctctatccatgcactgcctaattaactggattcctgtataagctgcactctgcaacaatgcagccacttttgtgtccttccctaggtatgaaacacaatttacctttacaactcttgccatatcctcctttaagctggctgcaggatcaacctatgcttctctgggcaagtcttcccctaggttgaatgtattatgaaccccctgccatatcttcttttaggaaaaatgctccctccacctatacactttctgacagaacctctactaagctggttatactatctaactttgcacctcctgctgcgaactcaataggcttattggtccctccatccatgcacattctactcggtgctctccatgtctggctgcaacttgaaccaattaatcttctaatatatgcttccctaggctagcttcaccctgcacctgtgcatcacttgccaagtctcttgtaaaatatatgctctcttttcccatccaactcctgctttacctcttctaggactggttttctctacctatgcaatgtttgctctcccctaccccacccctgtagttcagctgaatgctgcaaccatataccacctgcctatatacaactatataccacctgcctaagtatgttctaagctgaatgctaccccctcgcatgcatctcctgccttattttgcttattcccctccacccatggacttcttgccagaattatccaaggccacttgcatctcataaccaggcacctgctactatgtactaactattctaagttaatttcatcccctcccatgcactttctgctggtttctctcctaggttggcagtgctatccatcaatgcaccaattgcaatatcccaccctagaatggctttaatctctatacataaactacttgcagggtactccactaaacaacacgtatcctgcacccatgaattatctgccatgttctctgctatgctgcctgaacactctgctaacactgcttctcaggagacctgatctagtctatataatgcacccaaatatgcactacctgccatgtccccttgtcttgatgaaacctctgctcatgaactttatgaaacaaacttcttttactatataacagaaggcagtggtgcaagtcgaagcaaggtgctcacgtaagttaggtccttaatctcccgctgagactcagagaaagagctggagttatcaccctatatgtttggatttcaaagaaagagctttcagatctttgaggaaacagtttagagtagcagattaaccactcaaaggacagagaaaggatttacaatctcaagccttctaaagtaattgctctaacgggggtttgagggcctatctgtctattaccaggttttggttggaataaacagtaaattctcctggtaacatcaagctttctcaggcaggcatttcatgggcaggggagctgaggtcatcttagggacatggtgttaagctgctagaaataatcctagagttttttttttttttaagtttcttagcgaagaggtatggagagactttaagtatttgctgcagcctcaattgttacaccccaacccaggtgctgcctacacctctgcacttattgcaatatcctcccttaggcaagatgtatactccattcacgcatttcccaccatcctttgctttggttgtctgcatccttcaatcatggatcttctattgggtcttcctctaggatggataatctctccactcatgtaccaactgccagatcttcccctaggcttgctgtgcttcagtcatgcacttcctgccacatcctttttaagctgctccaccctaaacccacacaccttctgataagttcaactttagactagctactccattttctcttgtgcattctgctaggccctgccctaggctgcttgcaccatatattaatgaacctttggaagagaatttcacaacaatggatgccctcttcactcacgctctgctggattcttcctcaaactttctggactttccactcaggcatttcctgacatatcctgcccttggatggctgcaccattcaccagtctttccatatgctgccagtctttctctatgctggctaaactctccaaccatgcaactcctgctgaaccttactacaggctatgtgtacccttctttcttgtatctctcagcacagactggatattaccttctcatcagatgcacctcctgaagaatcctactgggagatggatactccttcccagtttgaactcttcctgcacacataaacttctgacttagtcctctccggttagccataccatatatccatgcacttcctggctaaccattcctacactgactacaccctccactaatgcatattcttcaagatacaccaccaggctggatgctccctccccacttgcatcaattaccaagtctatgcttggataaatgctcccttcaaccatggacttcatttccaatccttccctagaatgcttgtaatatccacacaggcacctcctcccatgttctaccctaaattaaatgctccctcctcccatgcatctcctgttggtttgtgctctagactggctgtatcctccatccatgcacctcttgctgagccctcctttaggctttatgttatgctcactacacccatgtgtgtcctgccaagactataccaaggctagctggtcacttcacatatttaactcctgtgcagcgttctcttagggtggctgcactttcttgccatgcatattttactgtatctcaacctagattgaaagcacactccatctgtagaccccattctgagtccttccatgtttggctgctccttctgaccatgcagagtgctccctcaggctgccttctcactccactcatgcagttcttcctgagtctcacctaagctagatgcttcctccacccgtggaagtactgccaagtattaccctatgctggatgaacactattcccatgctttccttgccaagatttcctctagtttttctgcacattcttctcataaacttcatgatctgcccacacatttcactcatatagttcttgccctgttgtctcattggaagaatgacccccacacccatacaactttggctcagtctaaccctaggctggatgcaccctccactaacacaccttccaatattccttcaatctgatttctcctacccccacctccacacacatatttcctgctgaatcttcccatcttttggttacattttctactcatttatgttatatcagatattccccaagatggatgcttcttccacccaggcactgcctatcaggtaattgtctaggcagactgaggcctacattcataatctcctgatgattctacccttagaatggtcactccgtttacccatgcactttttgatgtgtcttccctgggctggctgaatcgtccatccatgtaccacctccgtggcctcctatgtgctagatgtacacttcacccatccactttctcgcatgccttctcttaagcttgctagaacctctacccatagacttcatgcagagtcctcccccaagctgcataaccctctctcatgcgcttcctactgagtctttccttaggctgtatactctcttcttccattaatctcttgctgagactctctagactgaattctcattcctctgactcaccttctgtcatgccctcagatagtctagatgcttcctccactgttacacttaccatcatgtatttcctttggttgcatttgccctccagatcctcacctcttgccatatcttgccataaatttgtcacttcctctaatgatgcatgttgtagaaatccttccttagcctggattctccctccacccgtacaactcccatcaaatccttccctgggccagatgatccctccacttccgcacctctatccatgacctctactagactgcatgccccctcctctgatgcatttactgccaagtcttcacagagattggatgctccctcctaagtttcacttcctgtcatcttcttcttttggctggctgcaaccttaaccaatccacctctcaaagagtactatcctaagtttttggcaacttctgctcatgcatttactgttggatagtttccaaagctggcttaagctgccatttatgtacatccagcttgttcctccccttggttgactgcatcctccagtcatacacttgctgaagagtcaacccctaagctaggtgctccctacacaaaggcatcacctgacatattcagccctatattggctgaatatccatccatgcactgacggccggatctattgttgaatgcatactcccctgaatcattcacttcctgttttgtccaaccctatactggctgcaacctctacctatgaacaacctcctgcatcctcttagaactggatgccatttttcttctactaagacattctctaggccttctgcaccctctattcatgcaccttcaggttaatccttccctagactagacgatcacttcacccatgcatgttctactaacaccacctatagcctgcctgttccctctacatattcactccttgataaatgtatttcttgggttgcagaattccctactgtattagtctgttttcacactgctataaagaactacctgagactggataatttatgaagaaaagaggtttaattgactcacagttctgtaggcctaacaggaagcatgaatgggaggccttaggaaacttacaatcgtggcggaaggcgaaggagaggcatgcacatcttcgcaatggcagagcagtagagagaggggagggggaagcactacactcccaaacaaccagatcctgtgagaactcactcactatcatgagaacggcaagagggaagtccacccccatgatccaattaggattcaccaggcccctcccctgacatgtggggattacagtttgggtggggacacagccaaaccatatcacccacccaggcatgtcatgcctaatcatatcctaggtcaacagtatgcttgagtacttcactccttccaattcctacttccgttagaatctcctccaccatacacctgctacacagtcctccataggctgacttttccctcccctcatgcaactcatgtcatgactgaatcgaggtgtcaaccaatctgtacccatgtacatccagtcatgtcctctgcaagaatgtttgcagcctcaactaatgcaaaatttctagactcttaccataggctagctgcattctccacccacacctatctcaacacataacctgttgagatctccccagggtggctgtactatccacccatgttcattctttcaagttctcctcaaagctgagtgctttttttctcccactcacctcctgccagttcctcctccaggatcactgtagcctccacacacaatcttcctgttgctgcatacactattagctgattgtttactccaacaacatataaaatacagtcatgctttaggcatgtccttccacacatgcacctttgaaagatacctccagtaaggctggaagctatctcagcctacattactcataatatgatgtctagatagctagctgcaaaatacacaaatacacctccttctaagtcctcccctaggctgaatgctccctccacccatgcacttcttgacagcattttttaagcatagttccttcctttactcaagttcttcctgctaaaatcctcccttaaagtagaaactccctccacccatgcacttcctggtgaacttactctagggatgaagctgttttcacccaagcacatcttgctgtatactctcctaggctggctacaacctatgcccatgcaactcctgctggggcctgccttaggttggatggtatcagtttctatggaattcctgctgtgatctccacaagggtggcttcagtcacaacagatgcactcctgacagatgcactccatactggctgtaccctccacctttgtttctgctgagtactactctaggctggatgctccttccacctatttacttgataccaggttcacacatgggctctctaaaccctgcagcagtgctccatctactatgtgttcccatgcattagctgccagtgcttccgtttggctgaattctcccttctctcatgcaccccatactgatcatattttagtcctaagaccttctgctcccaaaagaccttgctgtgtcctctcctaggctggctgcagcctgaatccttgcaactctgccatgtactagctttgactaagtacacatctgagtgcagatggctgaggcactatctctgagtcctctcctaaacttggttcagcctccaccccatggactttctgaatgaatcttcccttgactctcttctccctccgccatgaacttattgctgagtcctctcttaggttgtcttcaacctgaacccatggtcacctgctaggactccccaagggtatatattccctgccaaatcttcacatagactggttcttccgcctatttcatgcacttcctttcaatactcttctaggctagctacactttgaaaccttgtatcatctgtcattccttcacctagacagactaaattatctttgatgcatctctctcttactgtatcttcacttaggtcgaataaactctcacccctgaacttcctgtcatatttgccactaggttggatgctgtctactcatgtactacattctgagctgacccatgtgcttcctgatgtgtccactcatgttcttgttattccaatgcactcatgaacctcttttcatgtaccccttagggtggtcgcattctttacccattcgtcttctgtcaggttattccctaggctgacagcactctgcactcatgtacttcttggcatgtactccctttatatggatgcatctgcacccaagtatcacctgctgagtcctccaggatgagtatgccttctaggcatttacttcttcccagatcctcccccaggctgcttgcaacttccattgaggaccttaatgctggtttaagttggtttttgccttctgccacgaaccttctgctgataccttccctaagactggaagctccctcagcccacgactctcctaccatgaacttccctattctgacagcacattataaacatacacaccctattgagacctcccctaagcctgatgcaccctccacccaggcactaccctcagtttgatgcactctccacccaggcactatcctctaagttgtttgcttccaaaacgtatgcacctctgctaaatcctcccttattctgcatgtcccttcattcacccatgcaacctctactgattccttcccttggttagctgcttcttccatacaattactattttactatttgatggaccttctcctaggctcactgcaccctcatccttcctacctcctgtcaagttcttccttcatctggaagctctctccacccaggaaccttcagccatatcctcccttagtgttgctgcaaatatcatgcattaatttcctacaagtcctcccttaggaaagatattcctttcaattatgcacgtactactgagtcctcctataaattgaaggtaaccttcaactttgcaccttctccaaaaacctatcctaggctgcctggtctctccacccttttatttcttgtcaggttcttcccaagactggctgcatattgcatgaaggcacattctgttatgtccttccctaggctagctgcaccttgattccatgcacccactattacatccaaccctaagctaactggatcttctctaatgcactttgtctgaagttcccctatactacttgtactgtgtaactctgcacctcctgcaatgttctcccctaggctggatgcatcttctattatgaattatctgccaagtgcttccctaggatagattttcctcctgtccatacacttccttatggattgtcccttaggctcactacacgctctacccatgcaactcccgccaagttctccattaatctggatgttcccttcaccaatgcacttcatgtcatatcatcgcaggctggctgcaacctccactcatgtatgttttgtagtttttcctctgggcaggatgtccctccagctatacatatactgctgggtgtctcccaagcctggttgcacaatccaccttttctcccctagcctggctgtgttctacaaccaagcactttcaattgtgtcatcatgttacctggctgaatcctaccccaactcacatcctaatatgtactcacataggcttccagcaatctgcacccatataccaactgctctgactcatcttggttgaatgatccctcctcccatgtacttcttgttggtcctcttctaggtctgtttccacctatgcacatcccagttggtcttcccttaggatggatgaatcctcttccatgcaactcctgtgtgaacctccaccagggttattaaactttctgccagtgaacttcctgctaaatcttccagtaagctgactgtaccttccaacatcgaatcttcctccaagctctctattaggctgacaattcttcccacttattcacttcctactatgtctttcccttggctcactatgccttgcaccaatgcatcattcccaacgaactccccaaggatggttgcaccctgtacccatgctccacctgccagttctcctctttgactgaatatgccttcccaatgttcaccttcttccagtccaattctaggtctaaggctttctccacctgcacttcttgcttggtccttatctagactggctgcactctccaccatatacctattgccacaacttcacttaggctagatactccttactcccatctacttcctttagggacatcatgggctggatgctttctccttccatacatttcatttttatcatctgctaggctggttgtaccttccaaccatatctctcctgccatatcatcccctaggttggattacctatatccacgaactacctaatgggtcctcctctgagctttgaggaccattaattcatgtaatttctcccatttctatccccctagactagctgtacaccccaccaatgtgctccttgtaaccatctgtaggctggctgcacactgtgtccaggcaccaccaaccaggacttcccctgctgtgaatgtttttttaaccatgaaccccttgccaatccttccataggttgcatgttccttctaaccatgtaattcttgccacactgtcctcttgaatgactatttttcttttcaactttttatcgtatgttgagcccctgccctccccaatacacacacacacacacacacacacacacacacacacacacacacgcagtagcatccctaccaagccatgtacttcctgtcaaattatctgccaggttcactgtaccctccacccatgcacttcttgccataacttccctttctctacctcaaacttccactgatgcatttcctgttattcttcccttaggtaatattctactgccacctatgaacgtattgctgggttctcccttagattggatgtacactacagctttgcacatcctgttgagacctcctgtagcctggatgctctctcgaaaaacaacaaacaaacaaataaaacaaacaaaaaaaacacttaaagacaggtcccatcagagcctgattgcatcctccaccaatgcacatcctaatattccccccatggactgaaggaaccagttcatccatgcaccatccacacatgaagggaggcagaaacctcctaccatgcaccatctactaggattcaacttggatcaatactttcttctaccatatgcacactctcctttaccctataggcctgatgcattttccatgaattctcaggatggttgtctcctgaaaaatgcactagttgctgggttttcttctggaatgaatggtcctcctcctatgcaccacccatcagggtcttatctaatataaatgtaactctcacctacgcacctctgcaaaattatcttcaaggctagatggtctcttcaccatgtattttctgctgtatcctccactaggcaggatcctcccttagacttcttcatgattgaacctcctgctcagtcctacaatagggtggctgttcctttcacacatccactccctgcaggatcctccccaaggcttgctgcaacttcaatccacatacatactgccaagccttctcctagtctggaggctccttacacccagtcactttcaaacataaccttctttaatgcgcttcaacctccacacacgtatcaccagtgcatctctccctggaaataataccccttctacttcagcacatacttctgagtccctgtctagtttgaatgttacctctgcctttgcacactctgctgagtccttccctagtctggttgattcttcaaactttgcacttccttccaggtgctcctaaagactggcagcactctgcaataatgcaagtcctattatatcatcccctaggctggttttaagttgcaacaataagttttctgatgtgtattcccacagactgtctgcacattattttatccatgtcttgtttatgcacattaagccatgtcctaacctttgatatctacaccctgttatccacattcctcttgccatatcctttcctacccaggatgaatgctttcccctgtacacttcctgctgattcttcccctaagcatgttgcacaattctctcatgagcctctgtcttttttttttttttttttttttttttttttttgagacggagtctcactctgtcgcccaggctggagtgcagtggcgcaatctcggctcactgcaagctctgcctcccgggttcatgccattctcctgcctcagcctcccgagtagctgggactacaggcgcctgccaccacgcctggctaattttttgtatttttagtagagacggggtttcaccgtgttagccaggattcttgatctcctgacctcgtgatccgcccgcctcggcatcccaaagtgctgggattacaggcgagcctctgtcttatcttcctaggctagcttcattctccacccatgcacctattgttaggcctacctcaatctgcactcatgcatcttctgcaatatcctgacctcagatggttggcccatgcactcatatgtcacttgtcaatttttcatcttggccagatagaccttctttccatctaccttctgcaggtcctattctaggcctgagggtctcttgactcatgcacttcttgcagagttcttctcttagttggcttcattgtgaacccatgaatctcctgccattttatccctatgaaagttatactctgcccatggatctactgctaactgtctagcctagctgcattctgaaatattgcacatcctgctaagttctccctctcatacctgtatccaccatccatataccttctgctgcattctcttctaggttggataagtctttaatatgtttatttcctgctggccacttccctagactggtttgcaacttccacacatcttgtttgtcagttactctattaagctcttcattctctccaaacatgtaccacctgcagattcttcctctatggttcattgcttccttcacccatgtaccctctgctgagcatctcttaaatgaaaattccatctatccataaaacttcctgctgtgttgtctctccagacttgttatagcacacattcatgcacttaactatcatgtattcccctatgctaactgcaccccaccctctggcacctcttgccatattgtttccttgaaagtctacaacatccattcattaacctcctgctatgtcctcccctaggatagctgtgccattcaagcatatatttcctgctgatccttttctatactgtctgcaatcttcacataagacctacctgctgggctctatattaaagcttgttgtttcttccaaccactcaccacctgtatgtggtgctttaggctggatgacttctccacccatgcaagttctgtcagtatttcctgttggggctcagaaaatgacaacctaaaatatgggcctcagaagtaacagtttctctctgaccttctcctgctgtcctgtatcttgtccctcattctctcctgaggccagccatagaaactagaatttctcttcctcaaggcagaatcatttttcctccaaagcagccataaggcctaatatattactctaactttccccttcttttttatgtaagaaatagctataaagtaattctctgaccaacctctctaattgtaggtcataagaccctcattccagaaaggatcttaccccatacctgagaggaaggaaggctgcaaggagtggccaggaagaatctgaacacacagtccttgctgagttttcccactcaatctgttagcattagctcataccccagtcgaagttctatatggctatctattattcattgaaaccaaagcataaaaatggacagctccccctgtatctttgggtcttcattatgaaggcttttatgtcatgaaaaactattatcgaataaattgttatcattttctcttcttaacttgcttttgttatagggatgtcagccattcttccttctgatggggaggaaagttgcagcatgttggcagcagactacatacatacaccacatgctgttttctcccttatgctggatgttactgccaggttcacctatgcgtatcctgtctgtgcctctctaagtctggctgcccccagaacaaatgcaccacctattacctcccccataggctagccacaacctccaaacatgcaagagttgcctattctccacaagaccaactagagcctccatccatgcatctcttgtgttcctcctacattacgcacccatgcacttcttggctgcattaggcccccatgtattttttagcaacgtctacctacaggctggatcccttctccatttatttactttctgttgggttctctcctaaggtggcagcctacactctgcatccatgttcttcttgccaggtctcatcttggctgaatgctctctcctcccattaatctttttcctatactcccctaggcctgatgattgctccacccatgttttattgcaggtccttctataggatggctacaccttccacccatgcattcatgctcaggcttcacctaggctagatacggcttcatccatattcaacttatctagcctttccctaggctgaatgctgtctccacccatgtaccatctgccaattctttctctacgcgagattctctctacacacatatacctcatgccttctttggactagcttcaacccctagccatgcatctcttatggttctcaccctaggcaggtttctgcctccatgtatgcatgtctttctgggttctcccctaagctggctatacacttcatcttttcccctctttcttagacctctcctagcctggatgcccactccatccatgcacttcacatacaatcctgagagcctggttgcaccttgcatcaatgtgcattgtaacatgtacatctagaagctggctacattaccatttttttaacctgataacactccctttggctgaaagttccttcttccttttcacattctgcctgacctctaacagacctgatgctgtccttgcccatgctcttcttgcacagtccttctatgggttggctctaccttgcagcatgcattttctgctgggacctcctatagtttacatgctccttactacattccatgcacatcctaaggagtacccgcatttgctagatgctccatccaccaatgcactttttgctgatcctcctttggaatggctgaaatttaaaaatatacatattttgccatgctttcccctaggtaacctgaatcatacagccatgaatctgctgccaaatactcattcaggcttctgcaccctgtacccatgcacttctcctgtattttacctaaactggcagcaccttccaaccatgtaccaatggcttatcctccataagtctgagtgttctttctgcagatcctcccctatggctgtaagctccctcaacccataaccctcatataatgaactcccctaggctggctgcacactgcacatatactcctcctgacaagtactcctgtaggctgctactacctttatgtatgcacttcctgccaagtacttctttagtctgcttgattcctccatcaatgaacatcctgtcattttctacatgaggccattgtcaccctgcacccatgtatcttgcattttgttctcccatagcctggctattccctgcacccatgcaccttttgctaggtatatcttgactgaatgcttacttgtcttatgaatttcctgtcattcatgttctaggcctgaagtttctccacccatgcatttcttccaggctctgcctctagattggttgcacactccgttcatttaagttacactggagcctttcctatgttcagtgtttcttgtccccatacttatcctgcagagactttcctaagctgggtgctttctcctccatgtattatagttctgctgaaccatttctgcatgatttctcctgtgcagtattatctccaagctatgtacaaaacatttggctctttcttagactggccatatattccacctatacataacctgaattaaccggctacttggccagttacagttggctggctacaagggcaattcctgccattccttccctaggcaagatgcaccttccaccaatgcaagactttccagaacctgacctagtctggattgtctctacacccacgcaattccttctggattctccctttaactagctgcatgctctacccatgaacctcctgctgagccttcacctagactgggtgctccctgcacccatgaacttcctgccataagctgattctaccctcatctttacatctcctgcatagtcttccgttagtttgactgctccttctacccttgcacttttggttgaatcctttcctaagttaatggcaccccacatcaatgtacctcctactatgtctacacctagcctgactgccccactgaataatgcaccacctacagaggcctctggtaggctggctgtaccctgtagttctgcaacttctatcatatccttccttaggctgcatgcaaccatcaatcatgcacaacctgacgaataattatctcatctagatattctcttcactagtttacttcttactaaattttcccctaaattccattcacccttgttttgaacatctggccaagtcttcccctagtctggatgctccttacacccaagaatctccagctgtatcctccgttaggaagcatgaaatctccaaccatgcatctcctgcagattcttccctaggcaggatactatttccacttatgtatatgttgcggggtcctcttctagactaggtgtaacctccacttttccaccttctactgggacctatcataggctggctgctctctccacttatgaactttctactgtgtgccccctgaggctagctgctcccttttcctagaaatctgctaaacctctccttggctgaatgccccctatgcccatgaaacttttccagtcctcttctaagcttgatatttctctatacatgcacttctttcaaattacatctaggttgtctgctcattacacacatacacctcctgccaagatcccctatgctacattctccctaaactcatgcactttcagccatattgccccagagactggcttcaaccaatatgcacttatgttttgtggatccttccctaggcaggatattacctctacctacacacatattgttaggtcctcctctaggttggatgtaacctccacttttgcagctctttctgagaccccacataggatggcagctctttccatccatacaatgcctattaggtcctgccagagctttgctgcaccttacacacatatgccatatactagatctccttttgttaaattcaatctatttttatgcacctcctgtcagtcctcttctaggcttgatggtttctccctcaaatttacttcttgcaaggttcttctttgggatggttgcactctccttctatgcagttcatgccagagtcacccatagactagatactcccttttcctgtacccagctgagtctttctctagggcaaatattccctccacccatgcagtgctgctgattagaaactggatgaaagttgcatatatgaaacttcttgtcatattctaccctgggaaggatgcaccctcctcccatgcaccatctactgaatcctctatgctagattcttttttcacccttgtacttcatgccccatattcccttgagctggatgcaacattcacccatgcatcttccactgaacttattttaaggaggtttctgcctctatctatgtatgtatttctggatcctctattcaccgtatactccaactttgcacatccttctggacccctcctagcttgagtatcccctctaaacatgaatttccagcaggttcctcccatagcctgctttaaccctggatctctgcactttatattatggccatatgtagactgcactcccctaagctggcttcaccttgcacctctgcacctcctaacatttgctcccctagttttgatacagcctcatccatgcaccatctgcctagactaaattatccctccacccgtatactttctgctgggctcactgcacccttaacccactgacctgccaaatccttccctattctggatgtttccttgagccatgtacctccatccatattctcccttaggctagaggcaaccatcacacatatgcatctcctgccagtcctctcctaagcaggatacccccttaactaatgcaggtgctatcaggtcctcttctaggctggaagtaacctccatctatgagtctcctgttagtactttctctagtctggcttttctcaccatctatgaagtttctggaagtactaacgctagcctggtttctctcccacaccaaattacattctaacatgtcctcctaacaggtggctaaaacttgcctccattttccacttgctaggactccttttggctgaatgctcactcttcctatacacatcatgagccttttctaataggtctgatgctttctttttacattatcctttctccatgttggctgcactctacacacctgtaacttccgtttctatccctggcaggatgtcccttctattcatgaaaaacctgtcaagtcttgccaagacttgattctctttcactcatttcttgccagatgctcccctcagttgaaagcaacatccaactgtgcacttcctgctgtattctcccctagattggatatttcttcaaactctgcacttcctaccatatgctcctattggcttgctgcaccctccgttcatgcatctatactgtgcccttcaataccgttgaagatccctccactcatgtgatagctgcttagtccttccctagggtaacttcaccttgtattcatgcaacagctatcagatctcacctaagctgaatcctccctcctcccgtgctcccatttctgatcctcttctaggcctgatgatttttccactcggaattctgaaagagaccttctcgaggctggaagaacccttcacttttgcagttcatgccagagcctaacctattgtacgtattctttattccatgctcatctcacagaatcctcccatatattagatattccctctacctgcgcacttctgctgatcctctcctgtactatgtgaaagttgcaaccatgaaactcatgccatattctcctgtaggatgggtacaatttccatccatgcacctgatgaatactctcatagtctagatttttccctctatccatgaacctcatgccacatctttctttactttggcaacaacctcaacccatgcaactcctgcagctcttacccaaggcagttttcttactacaccaatgaacatatttctagacccttccttaggttgactgtaccctctgattttgcaccaccttctgagacttcttctagtcttgctgctctatccagctatgaatttttagtaaggtcctacgaaggattagctgcaccctgcatcaatgcacatcataatatatgctctatgggctggctacaacctgctaccattttctgctggccaggactccatttagctgaaagttccttcttcccatttatctcatttattctaccttaggtctgttgttttctttacccatgcatttcttgcagggtccttttctaagtggctgcattctacacccatgcacttcctgctacgatgtgtataggtgggatgctcattgtccccatatacctcctgccaagtcttcccccagctgaatgctccctccacccatgcatttcttgctggcactctcctaagctggctgaagcttgtatatatgcatatccagttttgtcctcccatagttaggctaaacttatcttgcttgtaccctgcactcacacacctcctaccatgcccttcctcaggcttgttgaacatttcaactatgaattcagcatcatatccttcaataggcaggacgccacctttacccatgcatttcttgtgggtcttcccatggtctggctgtattctgtacccatggaccgcctgtgattttttccccttaaactagattctccctccacctatacacttgctgatgagttctcccataggctagctttattatgtactcacgtatcagcttccagatcttaattggcttgtatacatctcttctcatgtgatgtttgttatttttctaggcataatgatttttcactcatgaaatacttgtcaagtcttgcactaggctggctgcacactaacacattcagctcaactataactaatatgcccacacctatgctggctgcatcctgtacccagggacgtccttctttgttattttacagcctggcttcacagtcacgccatgcacctcttactgggtcctcatctaagaatggcacactcttcacccatgtacttccttccaagtcctcccctgagataaatgtactcttcatgcatgcactttctgcctagttctcccacaggctgattgcactctgcatccatctctatctactatgcctcctcctaggctggattcatcctgcacccacaaaacaatggccaggtatgccttttggttgaatacttttttgctgccatgcatacactactaatcttattataggcctggggctttcctcagccatgaacttcctactaagtcctcccctacagtggctgtactctcaaaaatacaccttctgccagggctttctctatgttggttgcatgctatacccctccaccttcagctatattctctcttagggtaaaagaactatccaaccatgtacaacctgcagagtcctttcatatgctctactcttcttccattcatgtaccttctgcaggatcattccctaggctcactgaaaattctacccatacaactcttgctgaggcctcccataagctggatatatcctccacacattcatttccttccaggtcctcccctaggttggctggaaccaccacagctgatttgactgctgggttctctatcaaactttccttcaactaggcagcacatgcggagtcttgctctagtctgcatgacccctctattcatgtgccttctgcagattcctcctctaaagctgcaagctcgctcaatccctgtgcctcataccatgaactcctgcagctcttacccaagtgtatatctacacttcctgaacactataagtatataccggctgccttgtcctcccctaagctaaatgcttcctccacgtttgcactgaatccctggtggaccttcttttgtggtagctgcttccttcacccatgcacctctgccaaatcctctgctaggctgaacactccctccactcattcacttactgccagattcttccctagcctggctgttttctccatccatgaactatctgccgagtcctcctttaggctagtagaatcctgtaccttatatatcagccactatatctgcccagagattaaatgcacactttacaaatgcatcttctgctggagcctcccctagctagatttttttccatccaatcgtttgctgccagatcctcttcctggttgatggcaccctccacctacacacctcatgccatattctcccctaagcagtatgtaccttttacccttgcactacctcttgaatcctcccctatgcttactacatcctccctgaaagtacccatgctgtgttcgcccattggatagatgctctccctacctgtgcatctctgactaggtcttatcctagcctgactacttcatccacccagatacctcctactgagtccttccctaggctagatgcaccctccgctcatgcacgtcctatggggtcctccaggctggtagatccctgcttccatatgcttaatactacatctgcccctaggctaaatgcacacccaattagtgcaccccctacaagcaactctcttaactccctgtgtcctcccccaagccggacgactaccatgaactaccctaagttggatacactctccacatatgctcattctatgatatcctcccctagtgtggctctacttcaactttgcacctcctattgaatcctcctgtagactgactactccctcccatgaactacctgccagctcgtacagtaggctgactgtaccctgaaccaatgcacctcttactatggtcactcctggactggttgcaacctagacccatgcaccttcttcattggtctcccctaggctggatgtatcttctaccactgtactacttgataaatcctcccctacaatatattcttcttctttccatgaacttccttccagattgtctcctagggatgttgctccctgcacctcatgcttcatctccccatagccagctgcaatctccaaacacacatttcctgtacttcttcccctagacagaattctacccccacctgtgaatgtattactggtcttcccctaggctggttgtaccctccaacttttcacctcctgctcggactttcccttgctttgttgcccatttaaaccaagaacttccagcaacatcagcagtgaatgtcttaatatgtcctaacatagtctggcttcagtctgacgccccactgactaagacttcatttggctgaatgattcttcctccaatgtaccttcagttgatcatcttctgggtctgatgtgttccccacctatgcactccctgcaaggactttctctaggctagctgccccttccacgtgtgtacttcatgttcaagcctctcctagcctaatgtcccttatttccataaacattctgcctgggcctgcccttgaatggatgatctgtccaaccatgcagttcttattgatactcttctaggatggctgaaaatttcaaacatgcagatacagcaatgatctcctctaggctgactgaaatgtccacttatgcacttactgctagatccctatttgggctgcctgaacctgtatctatggacacccctatccacccataggcttgttacatcctccaaacatgcactgccatatcttccaataggccggctgtggcctctactcatgcatctcctaagtatcctcccttcactggttgtattctgcaccatgcacctcctgcaagatcctcccttagttctgacacttactgcatccaggcacttctttcaagagctccccattgtcttaatgctccctcctctcatgccccttttgttgagtctttccttagtctggcttcacactgcccacatgcaccatctgctaggtttcacataggctgactgctctctcccgctatgcacattctggtggacttcttctaagactgatgccttttcttctcacacaaatcttgccaagtccgctcctaggctggccacacccaaactccatgaaactgttgccagaatcaatgactgcacactgtatttacgaactttctgctgagccctcctttaatctggatgtgccttctgtgcctgaaccccctactaagttctcttctagactagttacactcttcacccatatatagcgcctactgtgaacaatcctaggctggatgcatcctatacccacgcaccaccagccaggtgtaccctgtgaaggaatgttcctttctctcatacatttcctgctgatcctactctaagtctaaggctttctccacacacaaactacctgcttgttcctcttctaggatcgctgtagtttgaagctatgaacttcctactttgtttaccactggactggctaaaaccctgatcagtacaccttcttcaagggattttctaggctggctgcactctgtagccgtgtaccccttgctatttttttccactagaatagatccatccttcaacgatgtaccacccgtcaatcactctcttacactagattctccccgacccaagcacaccttgcctgattgtctcctagacttgttgtactctctacttatgccccttatgccttgttgtcccttaagctggctgaaaaccccatccatttatttcctgcttcttactcccatgtacctcctgccaattattttcttatactggctttgcactccacccttgtattgtctgcaaggtcacccacttagttgatgcttcttcctcccactcaccttctacctgtttctcctcctttgttatatgctcccttctcccatgggtgaccaaacaagccctccccttggctgcatttttcctcttcccatgcaccttctgcagggtccacccttagcctggattctccatccacccatgcatttttctgccatgtatatggcataatcacacagtgaaacaatataagtccagaaaaagagtgaagtattgatagaagcaatgaaaagaatgaaccttgaagacatgctaagcgaaagaagcagacataaaaggtaacatactgcataatttgatttgcatgaaatgtccagaataagcgaacctatagagacaaaaagtggttttcagagaatgggaggaagggaaatggtgtagtgactgcttgatggacacagggttttttgggtggtgtttaaaatgtcacagagctacatagtggtgatggttgtacaacattctgaatgtccttaattccactgaattgtatgttttaaaatggtgaattttatgatatgtggattatattctaatttaaaaaacaaacaaaacggcaaaaatgtgcgatgatatcactgaacaaagaatgtgaaaaggcaaataaaatgaaacatgaaatcagttcagtttgtaagtcaaaagggattatgaacagaaaaataggagcaccatacacaccatcattactctagagaagatatgaatgccacaatgaagaacagcctcatatcatcagtgcagtgctgtaagtgaacaaaagatatgaaagaggcaaaaagaaggcaccataaaccatccctgaagtagaaaccaactagaaatgtgaattgcaaagggaaggatcctaaaaccattagcgtgttagagcaactggacagtgggtgtgacacggcaaaaaagagaagcaccacaccataagtacagaagagaaactggatagagaaagtgagtggccaaagagaaaaagaaataactgtgctgaggctgtggaaaaagcaaatagacagatcctacgtcgttagttcactaatgtaactatacaggagatgtgacagggacaatcaggaagagatctgaaccatcagtgcagtggcataaatggtcagcgtgtgtgaccaggacaaataagaatgctgcaccatgagtgcaatggtgtaagtcaatattcaccaaagagagagcacttgacattatcagtgcactagtgaacagggcagggaatgtgaacatgaacatgtgaagcaggagtgcagtgcagtcatagaactagacaggatatgtgaacagagaaataggaagaacttcatatcatcagtgagtggaggaagcaggcggaggatgttaggaaaaagatgatcctctggccaagggatgtaaacaagaaaagaggaggagcctcctggcactagtgcaggggaatgaatagacaaagttcatcattggggataaaagggtgatgccaacttcatcagagaaatgatataacttggaagagaagggaaacattgtaaagagtaggagtcccacaccatacagtcagtggtttgattgttctggggaagtgaaaatagtaaggagaaagagtcctgaactatcaatacagtggcataacatggctgagactataaatagacaaagggtagctctacggtatcagtgtagtggtgtaagtggataagctatgtgaaaagaacagagatgagaaaagccatatcatgagtacaagggtatatgttgtcagaggtaaccctgcaaagaagaactcttgactattagtacattgatgtatctgggcaaaagataaaaacttgcaaagagcagcagctccatcctaccagtgtagtgtgaaaaatcgatagaatatggaattggagaagagcattcccacatagtctgtgcagttgtaaaactggacagagtatgtgaacaaggccaaacaaaagagtcccaccacaatagtgcagtggtataagtgggccaggtatgtgaacaaggcaaggaagagaacttagctttatccatgcagtggattaattgggcaagagatgtgaaaggacaaataggagtagctctgaaccataggtatagtggtttaactgtgaaggagatttaaacaaaggaaaaataaggtgccccacaccagcattaatggttaggtaaatgagaatgtgacaggaatagaaccaagaagtggagcctgacaacattagcacagttgtttaacagcacagggtatgtgaacaagaaaaacaggtgaattgccataccatcatgatagtcttgtttaagctggcgatgtgaattaggcaaagataagtcatactgaaacatcaatgaagcagtataatttggtgtagagtatgaagcagcaaagaaggggaacctcccagtgtaagtccagtcctataacttggcagaggatctgaataggctgataagtaggaacctgtggtcagtatagtaagaaaactagaattaaagaagaattaaactgaataaatagcaatagccatgcaaccttaaggtacaaagatactagggtagaggggatgttagctgggtaaagtgtaagatccccacactatcggttgtattatcgaattgggcaggattgtaaatggtgcaaataggaaaaagttggcaccatcagagtagtggagtaactggacagaagatacaaatgaaacaaaggtacgggctgggcacggtggctcacgcctgtaattccagcactttgggaggccaaggtgggcggaacacgaggttaggagatcaagaccatcctggctaacacggtgaaaccccgtctctactgaaaaaatacaaaaaaatcagcccagcatggtggcgggtgcctttaatcccagctactcgagaggcagaggcaggagaatggcgtgaatctgggaggcggagcttgcagcgagcccagatagcgccactgcactccagcctgggggacagagcgagactctgtctcaaaaaaagaaaaagaaagaaaaagaaagaaagaaagaaagaaagaaagaaaggaaggaaggaaggaaggaaggaaggaaggaaggaaggaaggaaggaaggaaggaaggaaaagaaagaaaggtacagtggtataactgggcaaggaatgtgagaaaaggcaaagaggtaggggaagcttggtataactgggaggtgaatatgaataggacaaagaagaagaagcccaatgttcactgaagtggaagaactgggtgggcaatatgaagagggcaaaagtagccctacaccctaagtacagcagagtaactggacaggagatgtgagcaagacaatgagggggactggttacccaccagtgcattggttcatcctggtaacggatatgaatagatctgtgacgaggagacctgtctcatgagtgcagtggaataacaaaaaagagattatgtatgaataaggcaaagaggagaaatcatgggctatcagtgcattggagtatcttggaagatgtgattaggagaagaaatggatccttgcagaataagtgtgctgtttaagtgggaagagtatgagtatggggcaaagaaaggaactccacccaatgcatacagtgctgtaagggagaagggatgtaaacaaggcaaagaagaggagccctgcctcaggagtagagtctcagaacttcagaaagtatgcgactgggaaagagaagccccatcccttcagtccagtgaagtaactgggtagggtatgtgcccagactgaagaggaagaccttggaaatcatcaatgcagtaatggccgaatatgaacagagcaatgagagtacaacagcataactgaacgagggatgtaaaaaaggccatgaagacaaggcctgcttcatcattgctgtggtgtacttggtcgggggatgtaaaaaggcaaagaaaggggcctcaaaccatcagttcattagagcatctggacagaggatgtgaatgtggcaaatagtagaaacactgccccaaaagtgcaggcgtttatctagatagggcatgtggatgagacaaagaagaaaaacctgacaccaaatgcagtgatgtaactgaacaggtaatgtgaaaatgcaaagaggtggttccccaaacccttagagaaccagagcagctgggcaagaggagaggtggtctggccaattagtaggagccccacaccatcactacagtggagcaactagccagagaatgtagacaggcaaagaggaaaaaccctatgtcatcagagcagtacagtaactgtacaacaatagtgatcagaaatgcaggatgatatctaatccatcagtgcagtgatataactggaaagtgggtaagaacaaagccaagaggagaagctctgccccattaatacaatggcatagtttaagcggctttctgaaatggcagaaatgagaagccccaaatcgtatgggtgcaggaagaaacctgcattatcagttgctgaatgggagatgtgcacaggaagtggggagaacccttatagtggtgactctggacaagggacgtgatcacagttaagaacagggactcagcaccaccagtgtgatgatataaatggaaatggatatgaaccgtacaagaggaatgaacacctcccccttgcataagtacagggtacagtgcagagcatgctaacagggccaagataacaagctctggaccattaatgctgtggtataactagacagggtatatgattgaggcaaatagaataaggtctgcaaccatcagtttatcagtgtagtggtacaagtgtacacacaatgtgaattagacaaagaggaggatgaagcatcatctctcagtagaagagagtgggaatggagcccagggcacagagacatgaacaggacatagaagaagagccttgaccaataacttcagtggtataacttgtacaagaatgttaacagggcacagaggagtaaccccacaacatcagtgcagaggtgtaactggaccagggatgtgaacaggtcaaagaagagcattctcacagtgtcagtgtaatggtgtcattgagaagagaattctaataaggtaaagagaagtatccctgccctatcaatgtgctggtgtcaccatcataactaggcagcagatgttgtctgtgcaaagaatagcagccctgcattaaaattgtaatagtgtaactacataggggatgtgaataggacaaagaggatgaggtttcactcatgagtacagtgatgtgcctggtctggaatgtgaacatggcaaatagaaaaaagtcccatgcccttggtatcatggtgtaactaaactagaaatttgaacaggaaaaagagggtgacccctgatgcacagatggaactggatgtggaatgtgagaaaggcaaaaaggaggaggcctatcacagaagtgcagtggtgaaactccacaggggatgtcaacagagaaaacaggagaatcttgataccattagtactgaggaataactggacaaaacatgtgattggggcaaagagaagatgccccaaaccatcaattcaatgctgtatcttggcagcattatatggatggggaaaagagaaagaacactacacagtcagcacagtgattacattgcaaggtgtgcagaacaagaagttacatgcccaaggcaccagcaccgtgttgtagctcagttgtacccggatcagcaatgtgaacagggtcaaggaaagcagtatcattgctatggtgtgagtgcacagtggatctgaatgagcaagtggggggatcatcacatcattattactgtggtgtgcacagatagagcatgtgagaggggcaaagaggaaggccatcatcccttcagtgcagtcatgtaactgtgtacagatcttaacagggtaaagaggagaatcctgacactgtcaggggactcattaaatggaaatggaaatgtaagctgcaaaaatgggcagcgccacattgtctacacagttgtgtaagtgaacagagtgtgaagggagtaaatatattctcccatcatcagtgcatgctgtgctaggccagaggatgaaaacagagcagagatgagcatatccatgctatcattgcaataatgtaaccagggcaaagaggatgagacctgactcatgaatgcaatgatgtaactgcacaggggaagtaaaaggcctgaaaaggtagaacctgcacaaccactacagttgagtaactgcactgaagccaaggatgaggcaaacaggagaagtgcagagcatcagtgctatggtgtaacctgggaaaggatgtgacaacgtaaagaggagtagccctcaaacatcattgcaggggtccagtttgacaggggatatttacaggcaaataagagggccaccaacattagtgcagtggagcaaccaggcagggacctaatgcaatgctgtgcctgactcagcattcctctctttatactatttgggggcagcccaaagtgactttgacacaaggcagggcaatcgcttcttgagtcaataagcattgcagtgctgctctacaatgccccaggaaaattacaagtgtggcttcaagatgccatgatttatagtcacaatgtcataaaacatttcatctgagagcctggtctgctttccagggtgtgaggtgacctgctggacactaccaagatagtggaaaaccaattcgcctgccatcctgctcagagcctgtcttgtgtttctctgctaatatatatcactgaaaactgtgaaagcagaggtcctaaatcttcagacattgtaatagtctaagatatatactcttgtataaatatgcacaatggttacactaaatggatgactaaagtgggaaccaagtcaatgacccaaatccagcccatagttacactaatggatgactaaagtgggaaccaagtcaatgacccaaatccagcccagaccatagtgactaaatgtcatcatggactgtccagcggccttgacaaattgagtttcaacagaaaaaagaatgggtcacaaaacaacctttgccacaactggtaccttattgacagtttctattgctatggccaggaaatcaatgggctgtgaacactgaatgatcctcttacccttggaaatgatccctgcaggccaacctgcaggatgttagaggaatggcttgcaggaacacacaccaatcctggctgcttctccttctgctctgggagcagaggggctgccctggattcaagattgtggacctgacattggaaagaatcacattgtttaccacagagccatctatttatccagctgtctttctcattgcatcactgtgctatgctaaatgtgcctaagttaaaaaaaaattgaaaaaaatacgctacatcaatgttcatgggtgcaaagtctaaactttttaacatatatatctgggatgagggcatggtgcttatgaaaaaaggacaggaagtaagtttagagaacagagtggggtaaccttgaggcatatagtaggggttcagcaaggccaccatacacagtgtggtttgttcactgcaaaaagtgcccagtcatggaggtgtggggttgctaaaatccagcccatatccccctctccaacatcaacaccccctgctgtgtctgcagggtggggcacttctgtctgagttctcttctcacaagggggaaacattttttatagagttttatagagtggggtgggagcttttccagttaattttcctaaagacagcacattttcattccgaggaactatatttttctcattcatttccacagaggataaccttttatttcttaaaaacacttcctgctgagagcctttcctttttacaatgaagccagccacctactcacccagcctgacaacagagaatgctttctttaattcacacaaagatgccatgtaagttgctggtgacctggagtctgtggcaccaaggggaattcctgatgcaagacagctcattcactctggcctgtaccagactagttaataaactgaggctgttctgggatacctacatgctctacaggtcctcaccactgcccctgtcaccctcaccctttctccagaacctagtaactacagagttagtgcctcacacagctggtgccctgaatccagctctacccattggtcagtgtttgtgatagagaagctaaaaagcaattatttaggcagttagtaagggtaaaagagttttggtggaacttccttttaataaaaagcagcccccaaatcatttgttttctaacagaaagcagactgaaaaatcaagaacccatagttaaataagctggacgcttgcgtgggtgaatgccggcagctgcaccaatagaaaagggatacctggaagtcaggtatattcaacatgggggttccctcttcccttttctttgttgccacgtgtgcagtaaaaaagcaggcagcatggtgccagccaggtaaagacccaatttgcatattaaagattagggtgtgatggccagcctctttacatgccatgtaaatggtgcacctggtccaaccaatcctctgccacctatgtaaatcaaacaacgcttcctcaagctcatctataaaaccaaccacatctcaccccaaacctggaaacccactcgggaccccttcctctgcaggaggaagctcttttctttctttcgcctattaaacttctgctcttaaacccactccttgtgtgtctgcatctttgatttccttggtgtaagacaatgaaccttgggtatttccccaaacaaatgacactgcttcatttgtaccatatttgttgtgaaatacttctaataacatccgtgatgacagactccagaaccctcctcaatttccaagccccatgagccccatccccatctcctaggatattttgttcactggttgccattggtttattccagtcttggactccatgactttttgaatgtctacaactaccctccccctctctctgagttcctaagcctcagccatccctgagaggtggccaaggcagttgtccaaaagagggcctgccaggctgctaaagaaacactgctgataactaacctgcacattgtgcacatgtaccctaaaacttaaagtataataaaaaaaaaaaacactgctgaagaaaccagcctctccctgaaagactatgctatctgtgaggagctatgagaaaaagtaagtctcaaaggaagagaacatagttcaggtcttaatgaacggagatcatcactcttttcagaagcatgctaccagcagcccttttaccttgtcgatgtatcactgccctgctgagtctaaatgagatcttccctctgtacctgagaacgtgattcttacactttgctgctgaccacaaggcgattcttggatggggctttggttttagagcaatttactatgatttggatatattaagaatttggtttgttgtgatcactcagctactggcttctgtgcactgctctcctctcttgttgcaacacagttctttgtaaatcacacctaattttaaatcctgagcatatggtctgttttgacaacaagattagcctaaaagctgaaaaaagaaacattccccagattccttttatatccaacaaccatctgtggtgggaagaaaaggtaaagacatttccaaatctgggtagagaatctcggacacaaagacaaaagctggcatggctcctcatcctcctactacgagctgtcctcaccaagatcctcaggccttgactatctctcagtgctgcattagtgagaatagctgttgatctctccactcccaggccctctgaaatagcagccactaacatatgtatggactcttctgctgaaatctgtcctggctgcttatagcagactcttttggtgctccacccctatcctttggtgccttaccactgcagtgcaagctctggaacttccagctgcctgaggacttttcttgacaaccaaaacccaccctgcctatgcaggccagctgtgagaaccagaaaattaatgtcctggaaagcagccttcagccaatgactgatggaaattggtgtctaaacagcctcagtcccttgagcctgagaagagataattctgaggtgtgacaaagactctcccaatcaaactttggtcaggctcctctgagctttctctttttgactaggcctcagttttgggcttcatgtccttccttgtagaatctagttttagcaagaatccagttttaggaagaaccctgctaagtcagttaagaaagaatccttactctctatatctgaccaccctcaatatctgatcaaattcctcatcccctactcttgatatctgatcacctggcctatcttcagcaagaatcctgttaaatttgtttagccataatccttctttccccttgacatttcctcttggtaattttcaatccactaacccccatccctttacttggttaaaaattcccacttgtccatgttgtattcagaattgagcctggttctacactgagatctcttttcctctacttacaatagttttttttaataaaatttatcttcaccacttgaacttctacccatctctggattttctaaacaggtggatgcattacactgattcccagagttcctcagtgggattgagctcaacttgttggatattacacctcttggtggatgctttcccttctccatctctctcccaactcctctgtttcattgcattacccccaccccaaatatagctacagtacatgaatcttgtttcaggtctccttctggggaatcccaatacagacactgcttcagcattctcatcctgtgttagataactggccccaccagtcattagcaccagcatcccacagacttgatatcagagagatttactgaaacaagactggaatcccatgtcctaggtctttctcacatggggtgaagtaataggatgatgcttttctagaactactcctgctcttacatgcccagcacagacagcatttatgttttctaggcctgttagagtgaccacagtattacaggtgtttatttctctcacctactgcatagtgcaggaataagttcactcaaaaatggctaactgaaggaggtaggttccttgttctatatgtgcaacaatcctgatagccccatatctgtgaagggcacatgctaaattatcccatcaaaatgcaggagtgttgacccttaagtatttcttattgcagaatgtcagtcacactactccaagacttcctcaaatgattgctcttttccagctcactgatatccatatacaaattgaacacgaccagacagacacttctttttcaccagtgcttttttttgcaacattttcatgtctcctgacaaacttgagtattctttaaaagacagactatgaaacactacttaatcagaaataaacttatttttatacttgcctacatttcctaatgactccccttttttcctttaagtgacctgttacttcttcacccaaaactttcaccatagtattcagttttattataattatagatacaaccaatcaatactatagaacaatttccagactttagattttaaaaacaatccacaaaaaatcaatacttaacccgatagaaacacttttgttttacattaattgacaactatcaaagatttgggatatatgaggaaatctagaatttttcaagtaaggttcatttatttacatattcattgtagaaagatttcttatgtacttactatgcatcagacactgcttaaggtatttgtgatccacagacttaattccctttgagaagtttataatctaggaggagagttggacattgataaagaacttcaagcttccatcataacccattttagaaattagagaaataaagttaaaaccttaacaaaatgaaagatccttaatgttctactcaaaaaacaacatgaccttttcaaatgtatgttattggcatatatttgggaggaaaattattaaatcatttttattaaaaagatttctttaaaaaaacaaaaataggttaaaatttaaattattttaaacatttgcagtgcttaatcatatttttagtaattattcagacttgactttctatatgtaaatgatttccacacataccttcagaaggtatattatgcacttctacttcaaaggttttattttgattaattttttgaattttgataatttttctcagggaattttacatgggaataacccatacataattatttctgttgcatctgcacacgacttgatgtagaattatttaatcacacacagtcttttccccttaatgtattatatgttttccttttgtatcctgctacgctgttgcattcaagagaaaattgattttgtatctttgtagataatattttctttttcttcctgaaaattcataatattctttatctttgaaattcaaaatgttagccattcacatccaggtactggacaatttgtattaactctgctttgaccataacaagaccttttcttgggaagattaacatttttttcagctcaagaaaacattattttcttctgtaactattatttctctttctttttttctagagttttctttcagccatgagaatgatccatatattggatctccattatttgtctttaatatccatctacttttcttaggctgcaactatgcagattttatgataaatgtatttatgttttgaatgaatagtcacgtgcatactataaagatagagatggtatatcactactagatgaaattccttgccttccttcatgatttcttcagtgctttctcagtggataaacggttttctcaaaagtataactcctccaagtatagtttttgtcctggtagaaactattgcacccataaccagttcatgtgatgatcaatcatcttccccttccatgtaacatacagtcctaggaaaatttgtgcaagtcagacagagaggggaatttttcaattcttcttatttcatagaactgtgggggtgccaaatttcttttgatatgagaatttaagttgcctctgatggagatgatcactcataaaactactgtagggattaaatgagttaatgaatgtaaaatgcctaggacagagcctgagtcctgatcagagagctgcactgtcagaaactggaatctccatttttctctgctggcagaacttagtgggaagacagggtggaggccttgatgactgtgaagtcagagaaatcagagcatgattcacagtggtcatggctttggccagcagggtgatggccagatagcctggggtcccatctccatgaagtcacttactgtctgtatgcccctagggaagttaatttacctgtctgggcctctcacatcttgaggttgcagatggacttgcaccacaaccacattccttattcttgggttcctgtggttctgcatgctcctccatgagtactccctacctctcagcccattacctctatcctgcccaggcagaagaacagtgactctagcaaggagcacagaaagataaccctgtggaagctgtgactgcctgggcacatgaactatatcacccaggcattccaattgtggagaacccagataacagtaaaggtgtgtgcataagcaaaggagcgtcatgtgtcatgtcagatgcagacatataggactgccattggtgtgagaatatgcttgggctctggccttgtgatctggcttagagttcatctggctgctgcaaaaattaattaaattgaaaattaataaaaagttaatatgtatcattattttgaacagttttatatttacagaataattgagtagaaagtagttcctataaattctctcttatcttccccagtttcccctatgattaacatcacacaatagtgtagtacattgttaaaattgatgagccaatattggtacatcattattaactaaatccatagtttacattaaggtttactctttgtgttataaattacatgggttttgacagctgtatagtggcatgtatctaccatcgtaatgtcaaacataataaattcgctgtcctaaatatctcctgtgctccacctatccatgtttcaccccaacccctggaaactattgattttttttactgtctccacagttttgcctttcccagaatgccatgaagtatttgttcttttcagattggcttatttcatttagcaatatgcatttaagttcctccatgtcttttcctggcttgataggttattttattttgtcactgattagtattccattgtgtggatgtactacagtttgtttatctattcacttattgaaagacatcttgaaaactactaagttttgaaaattatgtatatggctgctttaaacattcatatgcaagttttcgtatagatataagttttcaaatcatttgggtaaatgcaaaaaatgcaattaaattgctggataatatggtaagaatatatacatatgtgcatatatatacacatatgcatatacacatgtatatacacaggtatatatacatatgtatatatacatatctagatagatgatagctagatagacagtgtattgctctgtcacccaggctagactgcagtggcgtgatctcggctcattgcaatctctgtctcccaggctcaagtgatcctcccacctcagcctcctgagtagctgggacgacaggcatgcaccggctaatttttgtattttttatggacatggggtttctccatgtcgtccaggctggttttgacctcctggagtcaagcgatctgcccacctcagcctcccaaagtgctgggattacaggcatgagtcaccgcacctggcctgtaagaatatatttaactttgtatgaaactgccaaattctcttccaaagtagctattctattttgcattaccaccagcaatgaatgagatttcacgttggcccacattctcatccacatttagtattagtgttttggattttagccatttttataggtgtgtagtgatatttttagacaaaaagggatgtatacattcaatgcaacttttatcaaaatcccaatgccttatttttttaagaaatggaaaagttgatcctcaaattcatatgctattgcaattgacccagaatagacaagcagaagaataaatttggaggactcatgcttcttgatgttaaaacttattacaaagctataattaaaacagtatgttattggaataaatataaacataatgattaatataatagaattaagaattttgaaattaactcatacattttgattttccactaggatgccaacatcattcaatggggaaagaatagtatcttcaacaaattttattaagacaaatgcatgtccacatgtaaaacaatgtagttgggcccttatggcacactatatatataaaactaattcaaaatgagtcaaagacctaagtataagagctaaaattataaaaatccttgaagaaaacaaggataaatttttatgatctcgggtttggcaataattctttaaatatgccaccaaaaatacaagcaacaaaagaaaacaaagtcaatacatttgatctcatgaaaattccaaacttttcccatcaaagtacattatctagagaattaaaagacaactcacagaataggagaaaatgtttgcaaatcatatgtctgataagagactaatatgcagaatatatgaagaactcataactcaataagacaaataactcagtgaaaaaaaaatgaacaaatgacttgaatataaatttatccaaagaagatatacaattgtcaaataagcacatgtaaagatgcattagtcattagataagtacaaattaaaaccaccacataccatttcatatccactaggtggctgtaatttttttacataaaggtaaaataatgagtgttgacaagaatgtgaaaacattaggacctacacacattgctggtggcaatataaaatagtggaaccactatggaaaatggtttggagattcctcaaaatgttaaacacagaattccaataagacacagcaattctatccctggttacatatgacctaagtaatttaaaacaagtgttaaacatttgaacaaggatttttacagcagcagtattcacaatagccaaagtggaaacaaccagaatgttcaaccaatgaatatgttgtacacatgtaatggaatattattcagccacaaaaggtaatattgatacatgctacaacatggactaaacttggaaacattatgctaagaaagaaatcagacacatgaggccacatattgtattattccattactgtgaaatatccagtataggcaaatatgtagagacagaaagcagatcagtggttgctagaggctgggagaagagggcaataggaatgactacctaattgctttgaggtttttttgggggcaatgattatgtttattggaactaaatagtgatgacagttgtaaaatattgggaatgcactaaatcacactgaattgtgcattttaaaatagttaaaatgataaaatttatgttataggttgctatagtttgaatatatacatcctttcaaaattcgtatgttggaacctaatgcccaatgtgataatattaaccggtggggccttggaaagtgattatgtcatgagcactccactctcacaaatgggattagtgctcttttaaaagaggttaaagtgaatgcccttttgtcctgccttttgccatatgaggacacagcaacaatgaaccatcttagaagcaaagggtgagccttcaccagacacctaatccgttggtgccttgacttctagcctcgagaattgtgacaaataaattttgattatttataaattatgtaatctgtggtttttttttttacagcagcagggacaaactaagatatgcattttaccgtaataagaaaaagaagaaattagacttatgtcctgagtccgcctgagtcattgcaggcaaattttcacttcctcactctgatagaacttaaactatttattttctggtgagatttaatttgagaaaatcagttcttgggtaagtaaacaaagctgatgatgagatcctgcataacaataagcttatgaagtgagtgtctgtatatagaatagttaagatcccaagcatctatccccttatgaccgcacttgttctcctaaactggacagggtgttttacagcacctgatcaaaatgtagggagaaaattctatttgaggaaatttgatgaatcccagagaaactattcatatagataattgacaattaagggtatatcaaatatgtgatttttccattcgttatttgcctatggtaacactcgcctgtctaaaagacctacgagaacatgctgaatttataatacattttgtaaagcatcactctaaaataagtagcaataattcatgatgaaattgagataaattgaaagaaaaaatcaaaaccaagcaaaagggggaaaaatctttcttgaaaaatgatacaacagagaagctggtagaaaacttgtatctttgaaataataggaattttcatccattaaacaaagctaaactaggaacatttaaaaaacaagaaataatatttggaaattacatatatacacatacatatatatagttttgtgtttttttttttgagatggagtcttgctctgtcacccaggttggggtgcagtggcatgatctcagctcactgcaacctccacctcccaggttcaagtgattctcctgcctcagcctctcgagtagctgggattacaggtacccgccaccacggccggctaatttttgtatttttagtagagatggggtttcaccatgttggccagggtggtcttgaactcctgagctcaggtgatccgcccgccttggcctctcaaagtgctgggattacatgcgggagccactgtgccaggcctaaaaaatattttatgaaaaataaaatataaaatgttggaagataatgttaaggatctactaaagaaaatagaaaaagaaaaagaataatgaaattagggtgattttatagaaaattttccatcaggaacagtcaggggtgagggtgaaatgcatggaaaataattagttaaaaaatatgcaaaaatttcccaaaataactatatgactttctagaataatagagcctagtgaatgccaaacacattagataaggaaaagtcaagtaatacaacacgaccaccaataacaactgtttggggctgtttaggcatttactctctgaagacctaaattccaagatagattcactggcactacttgatacaaaattgagtaagaggtattctttgccctacctcagccctatttgcatggacctagtcaacaagaaaaaaatatcagtgaatggtaattggtggtgccataaggaatgatattagtaaaggagatgttagtaaagagatatttttaaactgtatgatgcttctttcagttcgcagttgcctactttactgctcatgcagtggacccagtttgggccctttggtatccttttagactatttccttcatgtacctcaatagcaacaaagcagatacaggacttactgacaggtgaagaggcacaaagtaggttattcctaccatcctatctgttagcataggcctcttactaactgatagttctgcaagaataccttgacaattttgctttgctttactagggtgaaaaattgccctaattgtttaaatggcctgttcaagtggggattagagaaacagcaaaggacatttttcccaaatatttcaacaaataaataatgaattagaaatggtgtttgtaatgtctatgtctgatggttaattgtatgtgtcaacttgactgggctaagggatgcccagacagctgataaaactttatttttgtttgtgtctgtgaaggtattttgggaagagattagtacttgaataggtagactgagtaaagatttccttcgccaatgtgggtgggcattatctaattcactgagggcctgaatagaacagaaaggaggatgactgatgatatggtttggatctgtgtctccacccaaatctcatgttgcaatataatcccaaatgctggaggtgtagcctagtgggaggtgattaaatcatgggggcagtttctaatggtctagcaccatccccctagtcctgttcttatgatggagttctggtgagatccggttatttaaaaggtgtgtagcacctctcccatctctctcctcctcctgctctggccatgtaagatgtgcctgtttcccctttgccttccaccatgattttaagtttcctgaggcctacccaggcagatgtcagtatgatgcttcctgtacagcctgtggaactatgagtcaattaaaccacttttctttataaattacccagtctcaggtattcctttacaacagtgcaagaatggactaatacataaaattggtactgaagagtgaggcattgctataacacttacagtcctaaggaatcttgactgtgttctgtcaaaattccagcaatgtatatatactattttcttgttactttggatacctatcacaaagttccttaagcttcattggtcaattgctgaaaaagaattgtgttactcaggcacttttgccaagaactggagacattacaccaggcaaaaacattgtgtttgaaatattgtattctttgttcagaaatgttaaatgtcaattctagaaacaaaattaactaaactgaaagaaaattaaaccaagctgctcatgatgccacttgggggtgttttgagccagcgatcatttgatttggcatcatgttatgattccaacaggattgatcctgctgtgctgcagctattaaaaaaccacagaaaaccctttatttcttccctttataattgtagccacccgaggcccaagatataaagtgggggtatttaagttataattttgcacagaagggagtcctctgctctgttgctttctgccttcgtggcatgactggtttgctacagttttcttttaataattttataaatcttgcaatttgttttgttaattagcaactgagcccaatttgaattgtgtaccccacagaccatagcgtaatgcaaaccagtatgactgcctgtaatttactccaccttttatggtgctcttgtcctatttggtcatgtttagaatcctttaccaccaatgcaacttacctacttcttccactaacacaactcttctgatcttttctccatgttaccctatcagccagtcccaagggcaggaaaattctacattttagtttagttgaagacccctttccaacatgatcttcctaaaacccaagtcaacaaagttgaggtatgagatagatattgttgaataaaatgacctggaaaaagaggtatttacattgatgccaagaacatgagtaagcaatccttgctggtgtgggactgtaagacagagagtaactgttaattggtttctaaagttttcttctgaaacaatgacattggaattgtaggggagtttcaacttactatactggttgatttgcataatagataactgtcaaacataggtagtttggattacttttacatgattacatttaatattgcacccattcatcttcctggtttgatcttgaaattatttgttggctatttatgttgattaaattacgcattacattttcttattaccatctgttgttccatcctggattacacttgaatgatctctcatcccctcagacttagagcgatccattgctacatttcaagtgtgaatacttttgtataattaagattttggattggactttgaatggctctaccttctccctactatgaagggctgctagtcaatgaattgtctttgaacacagacattcacaggtccccaaaacaatgtaatctttgtgtaattcctgataaatatgagcagagttataaagtccagactacttgacatgaaagcacatactgtggccttggtgatccagccgattggagggtctctatttctaaagcacaatctaagagcacaatctccatattccttttaaataacttaagcattaaacactgcagtgtgggtgaaacactgttttattttagcagatatgagtaccaaagagacatttgacaccctcctcccaccctctaccaatcatagtgttagagtaggtggttaggcagagatgagcagggcaggagagggccaccacacacccgcaggattgttaggtgaccatcaagtgatgataaggaagttgtttaactgtctctctaaaataataatgggtcatatctggtaccaggattagggtgagcaggctcaagcatgcacactaagagggaaaatattgaagtttaactgatatatgaacttcttctaggaatactcgactggtaaggaaaaaacagctcaaatgaacatgcacacaacttcagtgaacacacagcacatgtggcccctcccaagtgctggcaatccactgcacaggtggacagcctgctccaaaggaaaaatttagggaggagaaacggaaacaccagaagtatgccaatgtacaaaaccccaagtcgagggctgaagagcacacttggatctctcaagttgcccgcttggccctcttccaagtgtactttccttccttttgttcctgttctaaaacattttaataaattttcactcttgctctaaaacttattttggtctctccctctgccttatgcccctcagcagaattctttcctctgagaaggcaagactagagtttgctggaaccccatcagattcactgctgctaacaatagcagagaatttggtggttgtttccatatttaagcagaaaatacattgagacctgtaagaccaggggtggaaaatctcactcagttactaagacgagccttccttcctgaatttatacctaagttataacagtggaagtgaagcaggaaaactatacatagaaacaactccaaacaggcctagtctcatttggaatgctccctggacttcatgatttcacagttgtttactgtcagtctagaggtgtgccttaacacaaaccctatcaaatttaagaacaggatgttttcaaaattatgaatcaaactaagagtcattaacataaaatggcctcaagaagattgacaggagaaagagtttaaaaatcaatttatgtcctcagatgcttatggttgtagctcttcagggaattcctttcgtttagttagtagcactaaagtccttgcttgtgtacaataagccagacactattcttgtcacttcactatttgacaagctccctttaactataatgcttgtacttgagacatttcttaatgatttccgtttaaagctgcctgactcctgtgtttttgctttgagatttgactattaagtctttgcaactgtgaagcatttgctcttcgcctggttggtggtccacttataatgtaaaacgaggcccacgtataatgtaaaactttctataatgcatgaatctaaaagagaagaatattattttaaaagctgagaggagagaaacaaagtgtctttccggaaaagaaaagctaaagctgggtgcctgcctccctgaagtcctttgcgagccctgagcatcctgaagcgaatttacagcatataatcaagtgtgatttatcctgattgcatcagaactaattatggagtacctctcactcaaaacctccgtctaattagaagtatctggcaagaaggtatttgcatatcttcaagtcatattatgtcatgaggacatttgagctgatgaaaattgacatttactataaaattaaaataaaatgcattgaaaccaggagtcatcagaaattcacagctgtgcatttgggagcctgttttaattgatgagacatagtggctctgcatcatgaagcaaatcagaacatgaagaatgtaaatatacagagtcagaatatcacagcaagaggcagagctgcagacactgtgattggtacaggcatgtcccagattttggtttcttgctcttctcttcccattccttggtatttatatatcagattttaggagcaaagctttactctcactctcactgttgtttccttgtcattttaccattgctgtgccatttctacatattagagaactagcaccaaatgcctatagtaataattttcagacaaaagaggctcagagaaagaaggagtttacagttgattttcaggagaatgtcatcattttatgttactgtatttgccttctaataattataaagagtacctattaaagttacatcaataactgctgcttataatacgatgagcattgtcctatgtgcttcacatgaattaattaatttaatccttgaaaatcctctgaagtaaatgctcttattatctccacattaatgactaggaatctgggcctaagagtgatggaataatttgttcaagatcacctagcttctaagtggaatttgggatttgaacctagccaacatgactccagaatctgaattctaagcactcgcactcttcatgctagttgctagaagcaatcttcaatatgttattcacagggacacacacagacacacacagagtgcacagagtgattggagtaggactggcaagattggcaagtgactcagtcaaaccaataacatctttctccaggattcttgatgcaactgttgggaaagagacactcttttgtgtctagaattgctaactctaagaacactgtatatttagagcagtatcctttattccacgtggaaaaaaaacactgaataacttattgaaaaaatagcaactagcaacaaaagtgcagttgcttagagcttagaatcttgatttagattggctgggttcaaatcctgaatctcacttacaaaacagaaatcttgaacaaattattccatcacccttaggccagtttccaaatcattagtatggagataataatagcacctacttcttacaaatccaacaaagagaaaagtaaagctaagatatggaggacagaagagtaagtattaataatataattcaagccgctgtattagatagggattcagccatatctgaagacagacggcaccactgttttcatgccatagcccatatgcatctcttctttggtttaaatggtgtaagaacattttctgtcatgggtcctgagaagcacactatgagagtcaaaagatgaacagggagtgttatgtgtacttacagagcctaaatattgtgctttggagcaaggaatgatcttgaatgattagctatatcaggatatctccaaaaggagaaacacctcacctctgtcttccaaaacacgaaccaagaaattcacatttgtgttacagaaagcatttgaaatatatttttgctccattgtcttaagcacacctgacaaatcaagaaatcagtataataggaatgtgtatttatatgttactttacaattgatgatgtgggtttattccctgtattttgtcctcaaaacaaccatttgagcttcctgcagcatgttttattattttcattttacaggtgagaatactggggtacaaggagattagatagagctataaagcaaaatctacctatgactaagtaattactgaagtaaaaggattttttcaccacaacatgtattttttttttaaatgcagctgtaggtggcagttgttttacttggaaatgtgcaattcaaagagagtctctgcacatgattatatgtgcaattgtagtccggtatattcaatggctcattggatatataggactaaaatgaatatagatttattttagaagttgcagattaggtaattaaataaacagtgaacatagaaatctgggagttttgtgtgcatcaaataattttatttcttatttttttaatcctttccttagaaacactttttaaattcttataggctatttttcaggatgtgttaactattttggtaaattataattgagtgctcataatggcagtgaatatactcaattcattatctaaactatttcaaagggaatatgactacaaaaacactagctaactgaatgtattagtttcctatttctgctataacaaattgagacagatttaatggcttaaaacaatgccaatgtattatagcaaatgtattatattttaattctggaggtcagaagtctgaaatgggtcacactgggctaaaggcaaggcattggcaaggctgcatttctcctggatgctctagaggataatacattttctcgccttttccagtttctgaagtttgcctacattccttggctcatggcccccttcctgcatctccaaagcagcaaaacaggttgagttttcctcatgcttccatctctctggttctctctcttccacttgcttttttcacttacaaacacccttgtgattatattgggtgcacccacataatccaggataatctctgttcatctcaaagtcatctgattagcaaacttaattctatctgtaaccttaattctcctttcgcatgccacctaacattttcacagcaatcagggactagggcatagacatgtttcaatggagtatccttttgcctactacacttaccaaatttttatttatagttttgttatacaagaatgaatacagaatacgtttccattttgaaattttagaacataaaaacatcaaaaatgttaagtatctttcctaatatgtgcacaatatttgactataaaatatatgaatatctagtttctgtaggtgtatataacatttcacttgaaaatgagtgattttcatctgggtagtcacgatatattgataaacatttgacaatattcaaaacatttaagtcttcttttaaacttgtgcttctattccttcattagactttcctgtttgatgaaaaaccatcaatatttttggagacagggagctgtatatttggaaatactttgatttatatatgatgaataagtgactgagttcccaaaattagactttttgccattgttttaatcattattagttttgtccaaaacagcatagccacaaattgataagactggctctgaaggcaatctcaaaagaggagacaccaaaaaaattaagtaaaaagtcattaaatcacagaagtagttttatgatttatcagtgtgaatgtctaaattgactagctactctcattggtacatgagaaattagctattcagcatcattgtattttgaaccatatataagcccgtaactaattaggaacctcctattttttacattttcaaattattactattaatgaatatgcacacacacacacattttaaattgacgccattatatgtgtttctttggtagtgttgactttaaagcatccctagtggataaatataagtaactagaaattgctcggaaatgaagatgtgtataatgaatgcatttaaatcaaacgtagcacaaggaaatacttttctgctcctttatcagtcatattgaaactgcttctaagtgttcacagtaaggacccttcttgtgtctatttctctaacccattccttttccattgtcatgtatatatacacattgtgatattaataccacaatcaagctagtaaaaatattaattacttcacatacttactatttatgtgtgtgtgataagagcatttgaaatctactctctaagcaaatttcaagtatacaatacatgattattgattataatcaccacgctggatgttatgtatacagaactttattcttttttttttttttttcagagtctcgctctgtcactcagtttggagtgcagtggcgtgatctcggctcactgcaacctctgcctccccatttccagcaattctcctgcctcagtctcctgagtagctgggattatagtcgcctgccaccacgcccagctaatttttgtattcttagtagagatggggtttcaccatgttggccaggctggtcttgaactcctgacctcaggtgatccacccgcctaggcctcccaaagtactttattcatcttataactgaaaatgtgtatcctttgagcaacatctctcattttctccaactttcagcctttgtaaacaccattctactctctgtttttatgagtttgactattttagatacttcatatcagtgggatcatgcagtattttttttttctgtgcctggtttatttcttatagcataatgcattctaggtccattcatattgtcacaaatggcaggaattctttctttttaaaggctcaatattccattgtatgtatataccacttttttttctttatccattcatctgccagtggaaatttgtgttgtttctatattttgggaatggcaaataatggtacaaggaacatgggagtacagatatctctttgggattctgatttcaatttctttggataagtacccagaagtagaattgctggatcatatagtagttctatttttaaatttttaaaggacttccatactgttttccagagtggctgcaccattttacattccccaccaagaatatacaaaagttccctttcctttacatgttcagtaacatctttttttttttcataatagctatcctaacaggtatgaagttagaggaatgcctatttagttttgattgctcatttttaattgggttatttaactgagttataggagtttcttatgcgtatttgttatttatgctttatcagatatatggtttgcaattttttctcccattctgtagattgccttttcattttgttgattgttttcatatggtaattccagttttaattttttgagaaacctccacacttttatccatagtggttgtaccattttacattcccaccaacagtgtacaaaggttccaatttctccacatcctcaccaacattaacagtcttttcttttcttttcttttttttttttttttacagtctcactctgtcatccaggttggagtgcaatggtgcgatttcaactcactgcaacctccacctcccaggttcaagcgattctcatgcctcagccacctgagtagctgggattacaggtgtgtgccaccatgcctggttaattttttttgtatttttagcagagacggggtttcaccattttggccagactggtctctaactcctggcctcaagtgatccaccctcctcagcttcccaaagtgctgggattactggcatgagccactgggcccagcctgttgtcctttttaataacagctatccaaacaggtgtgaagtgtatcccattgtaattttgatacaacccaaagtgagcaatatattaaatgctattcccatcaaaatcccaatgacatttatttaaaatatagaagaaagctatacagaaatttacatggaaccagaaaagaaaaagactagaatagccaaagtgattttaagaaagaacaaatgtagagacattatatttcctgctttcaaaacatattacaaagctacagtattgaaaatagtatggtaccagcataaatacagatgcatagaccaatgaaaccaaatagagagcccccaaataaatctatgcatctatggtaaactgattttcaacaacggtgccaagaacacacgatgtggaaaggctaatctcttcaataaatagtgataaaaaaaatggatatcaaccacaaaagaataaagttgaactcctaatcttacatcatacacagaaatcaactcaaaatggattagatatctaaatatgagacttgaaactgttaaaatttataaaagaaactataaaggaagtttcttgacattggtcttggcaatagtttctgggatatgacactaaaagcacaggcaacagaaacaagaatagacagtgagacaatatcaaactaaaaaaatgtctgcacagaaaaggaaacaattaacagaatgaaaagacaatctatagaatggaataaaatatttacaaagcatttatgtattaaggggttaatatccaaaaaatgtaagtaacttctacaactgaataattaactaaataaataaataatccaatttaaaaatgggaaaaggatttgaatatacttttctctaaagaagacaaatgaccaccaggtatatgaaaaggttcttaaagtcactaatcatcagggaaatgcccagacccttctttaaaccaaaattagtcagcaggtctatggatagaatccaacatatgtattcaaacacttcactaaatcacttaattcttcattcttgcacacatatactgaatgattattatgtactagggactgttccaggcactgagaatacatcagtgaacaaaacatacaaaaactgctgacttcatagagtgtacatctaggaagaataaaaacaataaagaatagacacaataaattattaaattatgtaatgtaagtatgtgtaagttctatgaaaatgtattaagggagggtgagggacttcatgtgatatgtatgtgtggggaacggttgcaattttaattaggctgttagagtaggactttctgaaaataaatcattgaacaaacatatgaagattgcatggaatttagccatccagacacttggggaaaaccttctgggcaaaagtttctagtgcaaagtcttcagggcaggagcatgttgagtgtgttcaggaatcaaaatggaggctggagaagagttacaaagaggtgagcagtggaagatgagatcaggaaggaagaagagcatggacaatatggggtctgatagctcatcataaggaacttgcctttcattcttaataaaaaggggtcttgagcttcagagtgacatgatctgacaggttgtaacagagtaaccatgtcctttgggtttgtgtgtttgtttggtttagtttttgacaatagattgtacaggtccactgtggatgcaagaaggccagttaggagttgctgttacctaggagggagaatgagagcgtggagcaaggtagaagccattcggctcatgagaattgttgggttgtgggtattctttgaaggaaagacaataacagacacctttcgatgcatatctcatttttaaatcactgctgatcaatattttataaagataacccttttcttctcctgcagattcacctgcaagtttattctaagaattttattttttgagagttcatatccccattccctttccactccacacctacataaatgttcaaatttagtcttactttgttttggaccaattgtgtattttctcaaatttgttttaaattttccttcccacaatctaggacaatattccttaagtggtggttcatgggcctcttgcatcagaaagatctggggtgcttgctaagaatgcaaattatgcaccacacaaaattcaccaaggacccagggcatctacaattttaactcactctctaggagaagatagggagtatatgtgattgtaattttctcttgtcagcaagtcacatctgattttagcaaaaaacaacatccagcaaagtcccacaagaggactgtatcttgactttttgccactatgtggctatgtgatcgctgtacttccattgaaaatctaatagcttgtctctgcttaaaatgcatgcctgtgtcttctgttccctagtagccaggtacattaaacattcctgcatttgttcaataaatattggttgaatagttttatatgaccagaacaaagataaatcctaccctgtagttgccctatggagcttagagtcaagtgacaatatctttttaaagcaggatatacatttctgacttatttcattttaactgaaagcactcaatcagtattttaataatgaataaataaccaaaagttattctgatcacagaaagtattctagtttttcctatattcatgtaatccttacccccctttatatatattcgtttaaaatctcttggactttcttaaatttaaagaaaaattctaactgaatctaggaaataataaatacaaatgagactgaaattttatctcatttatttttgaactgagacatctgaagaggaagaaatgagctcagccatgtgctgaatagctcagaacatgaagtaaagtcttttaagcatgcttagtatgtttttcccattccattcaggatgcaaacttcacgtattctctctttccagacgttttctgctatttgcagcttggagggttctaagcactaatcagtggtggagagggaaataaacaatcatgacagttaaaggagttaatatagccaagtagtgtgaattaatgtgtgggcacaatgccctttgttagcagtcttaggaagcactccagtggccccacagtactggcactccatgttcttaataagcaaggaccctcagcctcacacagtctcacatgacaatgcaaaggcactggggaatgcacttggctccctagtattcagcattttgggagaaaaacaaaatgacagtagaaagtgttttacttgtttattccagaggaatgtattgtttcagtaggataaagtaggtcctttaaggaaaaagttcaaataaactatgcattaaactaagtctactaccaatatattaatagtattgcagccaagttatagtcatgtctctctgataaaaaggtgcaatctttaaataataaatttattgttcaaaatgtattaaagaaaattgaaatagagtagatcaaaactgagcttttccaagaaaaagatgtgcagcctaaactgccattcaaattacctaacttccaatagctttcatccaggactgccagctcgcctgcgatctacctgtctttgctcaaattaagcatccctttctcccccaaaatgtaaatctaatgctgccacaatagccattccaatagcaatgacaatgaaacttgatcttttctacttggaatgtgtgcaccttaagatacatgggctgtttgggaaaaggtattctaaactaaagccttttaagacacctttgtctcacataatcaattagggctgaattacataggccttcaatcatttgacaaccgaattctgtataaggaaatggctgatatcaaaagaagagtggcagggactgtttttataacatgttttaagagaataaatgtttttaatatgagtctgcaggaagacttcctttggcaaaaggcaaatggcatccaattggagtaaataacctacgtatgcaatgacaaagaaaataaatgaaaaattgtagctttggcatttaacatatccaaaaggaaataccaatcttttcagagaaagctatttagtctggcagtttctaagactataattttcttcttgctttgtttgttaccttaatctaaatcctacaaaaaataaactaaaataaattttccagagaatgtccttttctaagttctctgtaagcctaataaaataatgcatgtgtctctttatcttctctaaatgaaatttgatttggattttttctacctttattaaaactttctgatatttgtttgttatcactgcgtaggtatggatacctgaagtttagacttcagaaatggtctatttgcttccagaaactgtgcccccagttcaagaagctgagtagcaattatgtctcaattaataatctatgatttccttagatatctgcaacaagaaactctgattggaacataattcaattctattatatttttgtctgaaattaacatatttattacaactttgaatgtttaatattaatctcttctgggttactttggctcctcccatcaattctttccctcttccagtaattattgctgggtgaaaattttgaagttcatgttgaacttcatgttattccactgcctaaatccattcagtaatttttaaaaaatatattatctaaatggccacatcttatcaggaatgaatagaaaaggaatggtttgagacacttcatctcttcggctcacttcaaactatgttttcctccactgtttgtccttcagcttttctgtccttccagtgtttttctaaagtaactcactccctctggctgaagggcatttttatatattgttccttctacctagaacagtttctcccctactattagtcatttgaagtgcatttaaattgtgatttcttcaaagaagacttaccctctaaaactagatcaatttaatttacatttgtgtgcattattctttgataaatatacatctccctgactcgacacaaaactccaagaggataaggaccaagtctatctgtgtttaccatttcattaacagaacttcacattatgcattgatacctagaaaaaataaacaattaatgtgcttggaaagcatgaatatgtacaaaaattgcttctcttaaaacttgatataaattaaatgtttccttaccacatttaatgttagtttaccctaacattattatcctgtttatatccataattttcttattacttctgttgcagaaaaacaaaaaaagaaaaaaaaacatatctttttcagtaggcttttttcttctgagacttgacatgaaaaatatttaaccatctacttggaatttatcaaaataagctcactgagcttccttgtatttttaaccctgaaggcactctagcttatctgagaaggctctctgtgccactttcctcaacagactttagtagaccctgctttcttttctctaaccaacccaactttttaggcagaagggataaaattgttacttctcatggcaaagacagataggaaactagatgatattctccagatttgcataaaaaccttttccattaaaaagttttccttgtgtatctatctctgctaattttaaatagttctctttcctccactcatcatcattatactccttaatgtcttttttatagtaaaatttggctggagtttttttcattcataaattatccagattcttgattctgaaaaactttaaaaccaactgaacaactatcaattgtaaacagatcaaaataatagtttctttatactgagataaaatcagttaaataagtattcaataaaatagacttctagttctggggagatagagtaggcttatttttcctcattcttccctttaagcacaactgaaaatcttggacatcatatataatataaatatgaaaagactctgaaaggtggagagaataaggcagactgataatgtctgtagagacctcaatatgagcttggacttataccaatatccagtggtcatgaggtacccctctgcattttcactgactacggtgatgtcaaagtttgcctatcagtgagtagtggcaaaaaaaaatcaacgatataaaataactcaataaattaatcagtcaaaaggatctaattgacatttatagaacactatacccaacaacagcacaatgtacattttttaaaaaatgcctttataacataaatcaaaatcaaccatatcttgggccataaaacaaacttcgacaagttttaatgaattggagtcatacagagtgtgtttcttgaccacaacagaatcaaattaaatattaaaacaaaatacaacaggaaaatctccaaacactaagaaataagtacagcataatttgtaataattcgtgggttagagaagaagtctcaagggaatttacaaatacattcaactaaatgaaaatgaaattatagcatatcaaaatttgtgggagtagctaaagagcacagagagggaaatttatacaagagcaaactaaactcaaaccaagctgaaataaggaactaataagaataaaagtagataatgattacagtgaaaacagaaaaaatcaagatggataatgctgatgaaataaaaatcttggctttatggagattaataaaattgacaagcctctagtaagaatgaggaaaaggggaaataatacaaattattaacatcaggaatgaaacagtagatgctactactcaccaaccaggcatcaaaggataataagagaatactacaaacataaatttacaacttaaataaaatagaccagttacctgaaaagcacaaactaccaaaatttactgtgacaaataagtaatttgaatacaataagtattagggaatagatattttaaagtgaaaacctcctgaataataaatattcttataattctaagagaattttggccaccaaaattctgtgactctggtgtactttccctgtatattacccaggactctgcatatgattaattatactcccatgactaggttatattgtattacaaattgacttttaaaaaaagggagattatccagtgtgcctgacctaatcacaggagccctataaatctggacacactagtcagagacagaaaagtcagagagatttgaagaatgagaggaacttgacaaggtataaattatccattgctggctttgaagatggaggcggccatatggtaaagaatgtgggtggtttctaggagctcagataagcatctggccaacagcctgtaagaaaaagggtgacattaatagtataactgcaagacaaaatttttcaaacatcttgaatgatcttggaagagaatttttccccagagttttcagataagagttcagtctcgctggtgccttgatttcagtattgtaataccctgaacagataaccagtgtattagtccattctcacactgctgctaaagacatgcccaagactgggtaatttataaagaaaaagaggtttaatggactcacagttccacgtggctgcggaggcctcacaatcatggtgaaaagtgaaaggcacatcttacctggcagcagggaagagagagaatgagaaccaagtggaaggggtttccccttataaaaccatccaatctcatgatacttatttacttatttactaccatgagaacagcatgggaaaaaaccacacccctgattcgattacctcccacgggtccctcccatgacacatgggaattatggaagctataattcaagatgagatttgggtggagacccagccaaaccatattaaccagttatgccatgctggacttctgacatagataactatgagctaatataaattagtgttattttaagcttctaaatttgtggtaatttgttacacagcagtaggaatataatacaacagacaataagactgagacttttgagcatgtaagaaacactctctcaatccttcaagactactcactttgaaaaaaaatgtgaaaagatagttcaaacaatggcaatcggtgcctctgactccaagatgtatagagaccccaaggacccatgaagaagtatcccccaacagaaaatccacatctctcattattcataaataggtttctcagcagaaattgtgaagaccaggagagagctggatgttatgttcaaagcactgaaggaaaaaaatcccaatgaaacatactataccttgcaaaactgtcttttaaaaatgagggagagataaaggctttcccagacaaacaaaagctgagggcgtttgtttctaccagacctgccttacaagaagctgctaaaggaagttattcaagttgaaataaaaaagatgataagtggcaacgctaaagtatatgaaagtataaatttcactgataaaggtaaatatatagacaaatatagaataatgtaatactgcaatagtggcatataaatcactcttagccctggtaaaagagttaagtcagaagtattaagaatgcctataaccacaacaatttgttgttggatacacagtacagaaagaagtaattttaatatcgataacacaaaaaatattgagaagtgggagtaaaagtatagagttttgtaaacaattgaagtgattatcagcttaaagtggactgttataacaacaagaaattatatgcaagcctcatggtaaccacaaaaaaaatcccataggaaatacaataaaagataaagaaaaaagaatcaaagtatattactacaaaaaatttcaaatttcacagaagtcaggaagagaggagaaaaggaaaaagagagctacagaatagataggaaacaattaaaatggcaatagtaagtccttacctgttaataattactctaaatgtacaaactgattaatcaatcaaaagatatagattatctaagtatatttttaaagcaaaatcagactatatgatgtctagaagaggctcactttagaattaaggacatgcatcggctgaaagtgaaggaattgaaaaacattttccatgcaaatggtaaccagaagagagaagatgtggctatccttatatcagacaaagtagacctaagtcaaaaactgtcacaagagacaaaggaggtcattatataataatagaagggttaattcatcagggaaatataacaattataaatgtttatgcacccaacatcaaaggacctaaacatgcaaatcaaatattgacagatctgaagagagaaatacgcagcaatacaataatagtagaaggcttcagtactccatttgcaaacatagacagatcaaccagacggaaaaccaataatgaaatggcagaattgaacaacactgcagaccaaatgggccaaatagacatacacagaactttccacccaacagcagaagaatatagtattctcaggcacacatgaaacgtgcaccaatataggtcactgtgatggttgatttttagtgtcaacttgactggattaagggatactcaaatagctggtaaagcattatttattctccaattttagtatatgtgctgctgaagtgagcacattatttattctcgatgtttcagtagacacagagctagtccctcttctgccgaaagagaaacaggtgattatgctttttattagaattattgggctacactaggtgtgtttgtgaaggtgtttccagagaagattggtatgtgagtcaatgcactaagtgggaaagacctgccttcaataagggcaggcactatgcaatcagctgggggcctggatggaacaaaaaggtagaagaagggcaaatccttgccctctcactcctagagccaggatgctcttctctggcccttggacattagaactccaggatcttttgcctttagactctgggactcacactagcggtttcctggttctcaggtctttggctttgaactggtggtgagaattacgttattggcttccttgtttctgaggctcatggatttggactgagccttgctactggcttttctggttgtgtagcttacacacagcctatcatgggacttctgagcttacagagtcaagtgagccaacttccctaatgaattcccttttatagctctctgttgatagcctatcaattctgtctccctggaaaactctgactaaaagtcacaaaacaaatcttaacacattcaagaagatcaaaattataccaagtatctttaccaagaacaatgaaatgaaactagaatgctttaacagtacagaaatgggaaaattcacaaatatgtggaaaccgaattacagtctcttgaacaatgatagagtcaaagacaaaatcaaaagaaatatttaaaaatatctcgagacaaatgaaaatgaaacacaacatacaaaaaattatggatgtgcaaaagcagtggagtccaaagaagacctttctttgtgccatggatttcactggagccaggtttttacaaacatagcaatcataatgaatgtcacgcagaagaaaaatgtagttatgctgaacgtcagtttcacagatctcattttgaattctgactcttcattatcttcttcaaatttttgtcccaatttatatcataattgactcatagatttgatcttgattgttgactatccaacagtatactttttcctgatttgaacaacctctccttcatttgattatttatgtatgcttctagaatatgtatgccaacataaaatctccttttcctcccctcaggtcacatacattgtagaaaatagtaaaatccttttccttaccttttgttgttatcttatgcacattttaacacgcttcagaatgaaaaaatttattaaaataatgttgaggtttatatagtatgatagactgattaaaaacacagctgaaataattattttagttacagaaagtctcagttgtcaaacaatcaaatagatgataacataattaatcctaattgcttgttaacatgaaagcatcaagtagcaagatgacaccttggttcagttcagtcatcttaatgaccgaggcagaattctgtaggtttaaaatgtgaataattaactgctactgagttaaaaacaagtaaatcagctattaagcaatatacacgttatacattacttgtgtcagaaatcacagtgggagacagttaaaacaagtagcattactattacgatgtttacaaagtactttaacttacagcccaatttagtcttcacaatgatagtttacatattattattattatttcattttttaaaatttgtcctaaaataattaagtgtaaatggcttatccaaagtcatacatctaatgagtgctgtagttctaactcaagcagaggtctgaatctgatagcttttctactgttcctctatcgctatccatagatactaaaacacaacttttcaagttatattatccctaaaaaattaactcattaaattattttgtattttgaaactgaaatcatagtttcgtagttatcattgggaagggtggctagttttatggcaccataaattagtaatggtttataacaagctttcagctctattgacaatttcagaaaatttctcccaaaccacattctatgacattatgaaccaaattttttaaattttcagcaggtctttctgtcaaaaaattttcccttatcaagtggaaactctgttgttctctaatgtatcaagaaactagatgttcttgacagactgattctagttttcagctgtcttgattatttttctgcagccacttttgtcattactttccagataatctcatagttgttttttttttttttttttctttttttttttgagacagagtctcgctctgtcgcccaggctggagcgcagtggcgccatctcggctcactgcaagctccgcctcccaggttcatgcctttatcctacctcagcctcctgagctccagagtagctgggactacaggcgcccaccaccacacccggctaaatttttttgtatttttagtagagacagggtttcaccgtgttagccaggatggtctcgatctcctgacctcgtgatctgcccgcctcagcctcccgaagtgctgggattacaggtgtgagccactgcgcctggcctctcatagtttcttaacaatttacacagggtatttcgttttgttattattatttttttttcttttgagacagagtctcattgtgtctcccaggctggagtgcagtggcatgatctgggttcactgcaacctcttccttccgggttcaagcaattctcgtgcctcacccactggagtagctgggattacaggggtgcaccaccacatatggctaatttttatatttttagtagagatggggtttcccccatgttggccaggctggtcttgaactcctggcctcaagtgatccacctgcctctgtctcccaaagttctgggattacaggtgtgaaccaccgtgcctggcctgttttgttattttccactggatccattcacataaaatcagtttcacatataattgtagtcactattttaattgtctgtattccaaaacattttttgctatatgttacaggtattcaagatcctttacatatgttcattacatgtgcttgactgactatagctttctcagaggaagaaacattaatttccctaaaaatgtatatcttactactaaatacatatgatgcaaattatatcttcaaagaagtggtagaatttgttgagtggggaaagtttaggaagcataattactgtctttaggcctaggtcatacaggcccttgcccaaccctctctgacagggctcctgctggttagaccaacacaatcttctagcccatactctggccaatcatgtcctagggtttcccttctcaaatggccctgaatccacttccagggttgtgtgggcttcctcttgagcccatcacgctaagtacagagctatcttacatgtatatgctcctaagcccagtggataatcaagtggcagatgtcagtagggagatgtggaaaaaaaatttaacctgtatatgggagtgtccttatgggtgtaaggaccctgtcagtgtgagagtatgcaaagagaggagaaaagaagagagtcaacagggttcaggggtgcgctttttctgtgctgctactttctgaccttgaagtgaaaagagttcataacttgagcctgccctttcaggtgattaggaaagtaccttgtcaaggttggaacatagaccatgttttacttagtagtttcttagcattatatgttacctttaaattcatagatttatggcaatttggcctttattttgttctattgttatatgtcccacaaatgttataaatgacctgaacaagtatgatattaccagctagcgagttcacatttgttttgctagcatatgacaataacatattgaatatgatataatgtcagaagaatacatcgtgatgattatcagagccttgatgatttctccttagatttaaatggcttcacatctttccttttgtagatatcctaaatgtaagacagcatactaagaatttctcattcaaagtaatgacacaaatgtgaagagttcatactctcaatattcctgaagtaaaaagtcaaggcaattcaatctaaaattattcatccatttagaatacacatgtcaatcatgtgctgtgtatatggaatacatttttaaggatctcttggtaataaaaatataaatgggacacagttataattttcttatctaataataaagacaagtctgctaatggctataatgtagggcaacaagtagtttgtccatgagaagtaaatacattattctgcaggagtttcaaagcaggaaaatttttgcaggaaatatatgaattgcttcaatggtgcatttttgtccatccaccagaatttagtctatttagagaaaatgttgtcttctatatttatatgtcccctgctacacacactatctgggacatgttaggaaagacataaaagtttacttaataattggctgggcgcggtggctcatgcctgtaatcccagcactttgggaggccgaggcaggcagaacacgaggtcaggagatcaagaccatcctggctaacatggtgaaaccccatctctactaaaaaaaatacaaaaaattagccgggcatggtggcgggcgcctgtagtcccagctacttgggaggctgaagcaggagaatggcgtgaacccagcaggcggagcttgcagtgagccgagccgagattgtgccactgcactccagcctgggtgacagagtgagactccatctcaaaaaaaaaaaaagtttacttaataacttagaattggaagggtatttcaactatattatagaatacatgaagatggaactcaaggatttttttaaaaaggaggaagccacttgagtttgagaaactattataagcaaagtacaaatgggaaatttatataggagaaatgcaagtagtgcagctgagctttgttgttgtcttcctggagcaatggttgggaaaaaatttggaaagtcgtgcagattaagaaggccttgagtatatagctaaggagccttcaccttgttaagcaatatagtgtcaatgagtgtttttgaccagttgagtttcatgcatggaaatctactttaggaattttaacatctggccgacaagccaaaaaaaaaaaattctcaatatcactactcactggagaagtgcaaattaaaaccacaatgagatatcatcttaccaaagtccaaatggatattatcaaaaagacaaaaaataacagatgctgacaaagatacagagtaaaaaggactctcatacactgttagtgggaatgtaaagtagtacacccactatggagaacagcttggaggttcctaaaaattgagctaccatatgatccagcaatcctacttctgggtatatacccaaaagaaaggacatcagtatgttgaagagatatctacactcccatgtttgttgcagcactgttcacaatagccaagatttggaagcaatgtaagtgtccatcaacagatgaatggataaagaaaatggagtacatatacacaccagagtgctattcagccataaaaaggaataagatcctgtcatttgcaacaacatagatggaactggagatcattatgtttagtgaaataagtcaggcatggaaagacaaacatcaaatgtactcacttatttgcaggatctaaaaataaaaacaattgaactcatggacatagagaatagaaagatgggagaatagataatagaaccagaggctgggaagggtaatgggggactgggtgggagataggggtggttaattgttacaaagaaaaatagaaagaatgaataagacctacaattaggtagcacaacaaggtgactatagtcaataataattttacattttatcataactaaaagagtataatctaactgtttgtaacacaaaggataaatgctttaggggatggatacccctttatccatggtgtgcatatttcacactgcatgactgtttcaaaacatctcatgtacctcacaaatatatacacctactatgtactcacaaaagttaaaaattaaagaaaaaaagaaaacaatatagatattcctccaaaaactaaaagtagaactaccatttggtccagcaattctactactaggtgtctaaagaaaaaaaaatcattatatgaaaaagatacctgcacatatatgttcatcacagcactattcacaattgcaaatatatggaatcaacctaaatgtccatcaacagatgattggacaaagaaaatcatatataatttcattcattttatagcagaatagtatttaatatctatatataaaatacttatatgtatataaatgaaatactataagtatgcataagtgtatatatgtatatatgtatatgtgtatctatgtgtacatatatatatacaaaaaaattaaatgatattctgctacaaaaaagaatgaaatcatgtcttttgcagcaacatgaatgaaactggaggccattatctgaagtgaaataactcaatcaaataccatatgttctcacttataagagggaactaaataaaatgcacacatagacaacctctgtggaataatagaccctggagactaggaagggtgaaagggagatgaggaatgagaaattatttaatgggtacaatgtacattatttaggtgatggttactcttaaagaccagacttcaccactatgtaatatatccatgtaacataatcacatctgtacaccttaaatttatacaaacaaaaaagaaaaaaaggctgggtgtggtggctcatgcctataattccagcactttaggagtgtttgaatctagcctgggcaacacagaaagaccccatctctacaaaaaaaaaaaaaaattgaaaattagccgggcttggtgtcacatgcctgtggtcccagctacttgggaggttgaggagagaggatcactggatcctgggaggtccagtccacagtgatctgtgatagcaccactgcactccagcctgggtgacagagtgacaccctgtctcaaaaaaaaaaaaaaaaaaagaattttaatatcatggtttggctgaaaatacatgggaggagagactagagatagcagatgaactaagaaaatctttattcaacagccacttattgagaacttattagttaacaggccctgcactatgatctggagacactgaggcacataagtgatagctctgtcttagaaatctcagtagaagagactggccttcaagaaaaagttatagtacaatgtggtcagtgtttttgaaaaaggtgttacaaggacaatataagtgtagaaaagggatccattaaattccataaatgaaaacttgaatttgagggaagtaagagtggaaaaggaataagaagaattatcacaagatattataaaggttccctgaatgggactttatgttgtaaatacaagtgaacaggaaggtttaaagttggctatggctagagtatggcataaagagggagtaaaaatctactaaccacctcaggaaatgcaaaaggagagatttatttaggaggaagtacaatgatctaaccacatagagatgattgtttctttgggactgctggcagaaataatagcacaagtttactgaacagattatgtctcatgaatctcccaacttgtttcctacttctcatctaaagttatgcagcattggctgggcgcagtggctcacacctgtaatcccagcacttttggaggccgaggtgggtggatcacttgaggtctggagttcaagaccagcctggacaagatggtgaaaccccatctttactaaaaatacaaaaatcagccaggcatggtagtgcgtgtctgtaatcccatctacttgggaggctgaggcaggagaatcacttgaacccgggaggtggaggttatagtgagctgagatcatgccactgcactccagtctgggcaagagagtgagactccatctcaaaaaacaaaaaaaaaagttttgcagcataagggagtcagtaaagttaaactggtacgtaggcagcctctccttcattttgggataccagtagcataaatttaaccagagaaaaagtgatcagtgagaagatattgcacaaaactagcactaatcacacaggaccagaaagcaatttagaccaaacactgacaaacaaatacctacgagactgctgaaagagaatccagtttaggacattggaataagatggtccaacctgcaaaagctatgcaccttgctatgctgagtttccagaaagctactggacaagggctctgatatatccttaaataaagcaactttatattcctgattactatatattgagtttgaggaaagaatttcagatgggaaaagcggtaaagtaggaattcctttccttttaaagcagatgagtgcatctgtcctacctttcaggtcacaaaatgaaatatcaagcaaaatcactgagctcatgtgcttctagttctggcccatgttaccagctgaaaataagccttccaatcatagtcagttttgtcaggaaattttgtgaaatgagttcctgaaatgagtccattctcatagactattgaaaagttgttagagaaataacatggtaggagttgtcacagaaactcagagtctatttgatatacaaggcggtgaactagggagggaagattagaatctctccatactctattatgggttggcttagttcatgtgtgtaataattaaatttactgtactttaatatagagaaagaaaaaaacaataaaaactggaaggaatccactgaggtgatgaataggctaattaccctaatctgatcattacatgttgtatacatgtatcaaaatatcactatgtatcccataaacatgtacaatgatcacattttaactaacaataaaaggtaaaaaaagaaatagcctcaattagatttctaatacaaatgtttttatcttgagtgctggtttcattaatacattccttgtacatggaaggtgattaaataagtcaatataggtaaatttgtgttccagaaataaaaaaatccaaaatctcagtggttttaaacaacaatagttcatttgtacagtgggttcttccaagaaacaagatgctccaatccgtagtcaaataaaaagtgacactaaatattaggaagtatttggtataaaggagattcccataaacataaacatagaagatgggcttggaagaggggagtgttttctacatactcatcccagagcctctcccagaccttctgcagactctattcccttagcacttatgttgaagctttcaaaagatctgaagattagtgaatcctgacatcactgcattctggtttagttttctataaaattttctttttctactaattgttcagcataagaaaagtctccagcctaaattataacagggcccatattattaaacaaaaatatatttattttaactagatagcatttaaaactaaaattgcagtggtttgccaagaggccaagcataaatagtagttgaaatacatatatatttatttaggaatgctggttcagtttcatggatttttgagctacgttaaattttagaaaagactttaaaatttcttggcttataaggtgttctggagaaattatagacttttaaatattaaatcagtgacacttgaaatcacttctaatataagtttaaaggacaagggggaatatatttaagctaaaacattatcagtagttaacacattgtctttgacaactgttgtagcctaacattacccaagtccacctgattacttctactagaattgcatcacatgttggagggaggaattgaatgcagataccagaaagttcccggagaagcctggaatatcttctgattttcagttatagctgttgtatctaaacctcatgcaattactattctaggttcagtgctttaataatactatgaaatttcctgaaagtaagaaatatttttgttaaatttccctgagtttcattaataaaagtttgttgtattttttgtgtgtgttgactgacgttatgtttcaagggatccgagaaaccctgcagctgcaattttatgaaggcagatttgtttttgttttcttgtttttcctctctctctctccacacttctgattacaatgatttctgttgattaaaagtggaacatttaaccttcatttaatttgaagattctgagtacagcaggtagcctttgcttaaatttccaactttttgggggaataggtggtatacggttacatggataagctctttagtggtgttttctgagattttggtgcacccatcacctaagcagtgtacactggacccaatgtgtagtcttttatccctcacctccattcccacccttcaccctgagtccccaaagtccattgtatcattctaatgcctttgcatcctcatatcttagctcccacttataagtgagaatatacaatgtttggttttccattcctgagttacctcacttagaataatggtctccaattccatccaggttgctgcaaatgcccttatttcattcctttttatggctgagtagtagtattccatggtatatatatatataccacatacatgggccaacttatatgaacaagatgctcctttaggacaaggactacaactgctcattcacatacagtcaaattagtgcattgaataaagtgaagactgaatgaattcactaaaggaacaaccagttggcttcagactgtctagattcatgttctgcctttgctccaagttccacatttataagaagacaggaaaaagttttatacttccttagtggctgatccttttggtaatcactctgcagaattagagaaatatctatctcctggattcttttagctccaaatgtctaaatccctaagaactgagactgtgctctcacatccactttattgcctaccccatgaaacctgctgtgaggggaacatggagcaagcttactttccccaggcttatgttttcctacaggccttccaggacaacttagttctaacgttgtgttccccagtgatgttgaccagcattcaatttgtcaagtactttactacacttgtttttattcaatgaaaacagatagtagtacaatattgtctttcacagcatctaaaatataaaatgtaaataaacaattgaaaaattatttccctttgaaggaagggagtattttgtactcaatatagagatgactaataactttcagtgaataaatgttccataaaaatatagaatgagattttggacaggaatttttcctcctacaaatggtaaaagcaaaaaatgtaaagcagagcatgaaggcttgctattatttttttcactgaaaaattgaaactagtgtattttcagttaataaagaaatacgtaaacacctctttaatctagcatttgtatgtacattgcactgctttgaaattccacattcccagtcaaggcttggcagtaaaatagctcaaaaagcacatgacccatcagacgtaatacatattactcacaaaaataaactgtcctcttccctagaaaggaaagtatataaattttaaatcacagcaatctaccattgaaaaaaaatttttttgaggagccaccagaggctagataacaaggcactgtgctcagcacaaaggactgaatgagtaagacacaatgacaaagaaaattaatgattaaagcagtaaatcttacagcttgaatttgcagtattcaaatcactgattgatttaaacaattaactaatgggccagttaatgcaccaggtgaactggggtacttatcactttctcatccatctacaagaatataatattcctggccatagtttctttctctatcttgtttgtggctgcatcttctgagcccagaatactgcctggcccggagtaaccataataaatgtctgctgaaaaaaagaattaattcactcactaaataattcagttcatcttctattagaaacctgtagcaggttctttgacagtttgtaagatgaaaatgcttggcccttattgtgcactggagatcatatgcttgaggtgaagagcagactatctggagtcatattccttgggtatgaatcataccccccaaaatcaccagctgggtgaccctggataagtttcataacatctctgacctttgctttgtacattttgtcatttaggaacgggtagtcataatctactccttacagtactatgttaaggttaaattatccaatacatattcagtgcttaacataatgccagggcatactaaacaactgttcttgtttgggatactattttcaccacttaataacattcagctcatctgaaacaactcgtatctctaaaaccaagtgaaattactctggaaaataaaaattttaaatactgtaaaatcttagttatggcaaaatgcctaaggcacagtaaattacaatccaattcactgcaattatgaagaaacctcaggaaatttgatttccagtagttgtagcccttgcattagagaactctctctttatctcctgtgcatcactttctaagcaattactttacaatcagacaggcagcatcaagttgttcttttttcctaaaaagtgtggatgaaaacaaagtctcggcaggggtgggtacaaaaatgaaagaaaggtgttcatggggcccttgcctagagagtaagagaaaacagataatatccctgaagggagaccctcataacaatgctacacgtgtttctatttattccaaactggaattaaagaagttagattacctgtttgcatccaccatgattttaaatagagaaaaccctaaagactctaccaaaagaaaatgttagaaccaataaatgaatttagcaaagttggagaatacaaagtcaacatgcaaaagcagttatatttctatactttaacactgaaatatatgaaaaaaataggaagacaatctcatttatggtagcatcaaaaagaacaaaataattagaaataaatttaaccaagagggtgaaatatctatacactgaaaactgtaaaacactgatgaaatacattaaagaagataaaaataaatgaaaagatatttcatgtttatgatggtaaaaattaatattgttaaaatatcatactactcaaagtgatctacagattcaatgcaatctctattaaaattccaattatatgtttttaagaaacagaaaaagaatcctaaaatatagatggaaccacaaatagccaaagaaatcttgaacaaaatatacaaagccagaaacatcacattacctgatttcaaaacttactgcatacaaagctataataatcaaaacgtgggtaaattttatgatgaagatgccaaaagcaatggcaacaaaagccaaaattaacaaatgggatctaattaaactaaagagcctctgcacagcaaaagaaactatcatcaaagtgaacagacaacctacagaatgggagaaattttttgcaaactatgcataactatgcatctgacaaatgtctaatatccagcatctataaggaacttaaacaaatttacaagaaaaaaaacaaacagccccattaaaaagggggcaaaggacatagacacttttcagaagaagatacacatgtggccaacaatcatatgaaaaaaagctcaatatcactgtatatgcaaatcaaaacaacaatgagataccatctcacacaagtcaaaatggctattactaaaaagtcaaagaataacagatactggcgaggttgtggagaaaaaagaaggcttatacactgttggtgcgaatgtaaattagttcaacctttgtggaagacagtgtggcaattcctccaagacctaaactcagaaataccattcgacccagcaatttcattactaggtgtatacccaaaggaatataaatcattctattataaagacacatgcacacgtatattcattgcagcactattcacaatagcaaatacatggaatcaactcaaatgcccatcaatggtagactagataaataaaatgtggtacatatacaccatggaatactacgcggccataaaaaatgagatcaagtcctttgcagggacatggatggagctagaggccattgtccttagtaaagtaatgcaggaacagaaaaccgaataccacatgttctcatttataagtgggaactaaatgatgagaacacatggacacatagaggggaacaacacatgctggggcctatcagagagtggagggtgggaggaggtagaggatcaggaaaaatagctaatggacactaggcttaaaacctgggtgatgaaataattggtacaacaaacacccatgacacatgtttacatatgtaacacacctgcatatcctgcacatgtgcccctcaacttaaaaaaaaatcaaaacaatgtggtattggcacaaaaaaaaatagatatagggaccaataaaacagactagagatcacagaaataaatccactcatctacagtcaactgatctttgacaagggtgctaagaagaccaatagggaaaggagagtctgttcaacaaatgttgttgagaaaactggatatccacataaagaaaaatgaaattgggcccttatctcatccacataaaaaaacacattaaaatatgttgaaggcttatatataagaccgcaaactgtaaaattactagaagaaaacacaggggagaagcttcttgacattggccctggcaaaggtttttggatatgacccaagaaacacaggaagcataagcaaaaataaacaaacgagattgcatcaaactaaaaagtttctgcacaacaaaaaatcaaaagtatcaaaagacaaactatggaatgggagagaatatttgcataccatatttctgtacaaggttaatatcgaatatgtataaataattcaaatgactcaatagcaagacaacaaataacctgattaaaaatgcacaaaggacctgaacagacatttatcaaaagaaaccatacaaccatacaaatggccaacagatatatgaaaaggtgctcaacatcaccaatcatcaggaagatgcaaaccaaaatcaaacacaatgagatatcacctcacacctttaccttttaggatggctttcatcaaaaagatgaaaataagaagtgttggtgaggatgtggagaaaggaaaacccttgtacactgttggtagggatgttaattagttcatctattatggaaaacagtacagaagttcttcaaaaaattaaaaatacaactactaggtggtacagcaattccatttctgggtatatatccaaagtgaatcaaatcactatctctaagagatatcttcctctcatgttcattgcagctttattcaaaatagctaaactacataatcaatctaagaatacattaacaaatgaatagttaaagaaaatgtggtatatatacgcaatgaatactactcagtcttcaaaaagaaggaaatcctgtcctttgtagtgacattaataaatcttcaggatatgataagtgaaataggccagctatataaagaaaactactatgagatctcatttatatatgctatttttaaaactcaaactcatagatattgagagtagaatagtggctaccagggcctgggggtgtagggatactgggagatgttgttcaaggaatacaaagtttcagtcatataggacaactaagttctgtaagtatattgtacagcattgtgactataataattgtactatatacttaaaaattgatgagagtagattttaaataaattttctcactgaaaagaaagataagaatgtgagatgatagataggtgaattagattgattttatcaacattatgtagtaccctataattatatgcaataaaataaaactggtgcttgctcactaaaaaaaataaaattttaaaattgatgcatattttacaataattattacagtgtctatgaacatatttttgcaatatgaatatttatgaaatataaaccaacagcaggaatgaaaggtgtgaaatggcagaatgtcacagaatgccacgttatagatgcacagtttcaggagacaggctacattgcctgctgatggaatgttgccattatcaagctgaggaaatgctgcccagacttcagattcctttctcccaattattgattctgctgaagtgaagtccagcaagcttcactgcaagctcaacgttaaggggataaaattcagtcatctcttaaatggacaaaatacctatattttctccatgttcacctaagtcagcactacgatctaaatatttgttcacctcccatctgcccaaattcacatgttgaaatctaatcaccaatgtgatgttattagaaggtggggcctttgggagatgattaggctcatgaattaggttatggcccttgcaaaagaaaaaaataggcctcagaacactactttgctccttctgccaggtgaggaattagcagaaggagccatttatgaaccagaaagtggaccctcaccaaacacagaatctgctggccccttgatcttggagtttccaacctccagaaccatgcaaaatacatttatgttgtttataagctacccagactatggcagtttttaatagcagcccaaatccactaaaacagtctctctttatttgcctgatatcctgggattgttgtataaaatgatttggaaaagtatcaatgattaatcaccctggaagtgcatttgttacacaaaaagggggtcttggagctacagaggcttgtcccaaaagaaggagttgtaaaatctcaggtactgaatcattctctttaaatagcaggattcaagaatatgatgtagaaagacacaagcaacaagtccatgtgaactttcaagctgtctgtgtaacatcagacttcattaaggtcaattgtatttggagtaggctgcatgggacacagtcactatgattcaaacatacccacgaacagtggcacagtattttatagtatgtattatcttgtggcaaaaaatgttattgaaggatagtgtgttctgtatttttagaagtctagttttaagacagcagtatgagtctctcaactctatctttcactaaaatttatgggaaggggcaaagctacatcaaatagaagtatttagccaggctagaaaacaaataagaaaggaaaataacgttttcaagtgttactttttcttcaaatttgtctataatttaaaattaatttgaataaaaatactaacaagttatttttgtggaactataacattgatttaacaattaagatagaaagtactggactttaaaggagccaagacaattctcaaggagaacaaagaaggaaggagaagttgccttacccaatagctaataattaagatactctagtaatcaaaataagtgttattggaagagggatagacaaataattcaatgaaatattataagatattcagaaagtgccccaagtacatcttggaacttggtctgtattggaggtgagactacaaataaagaagtaaggaattaattgctcaataaatgatgctaggaaaattgtctttctgaaagtcaaaattaataaaattggatatctaagtcacttcacacacaaaaagaaatttcagaaatttaaatgaactattaataaatgtgaaaaatttagaactagtaggaaaaagtacaggtttagaatttcttaattgaaaaatggcaattataatctattaagaattattgatacatttaactacattataactatataacaataataactttgaaagaatttttaacaatcaaacacattaaaggcaactgctataatagagtagcactgaattcaatgtaatgtctcacaattgctgcactctccctcacccaagtgtacagattctctctctgtgctgcacggctgctgctgagagatgggggaggagtggtgtcctttttcagtgccttttttcagtgacatgaatgtaaaaccgggtattgtgagtgctcacctgatttttggttcttataaaggtgctttttgtgcatagatagtagttaagttggtgtccttgcagaggggagaatcaatggagccttctattctgccatcttgctccacccttcctcaacttgttcatttgatttttagtgtttttttcaaggaacaacaccctctgtttggccatttttgtacccttagaaaattgtgaattaggcaatatagaggtaagtactttgtatctgtccttcggaaaacccccagtcaaatcataatatacaaataaaattttttggaaataaatgctactctgctctctccagaaccaggcatctacactgataattaaggctgtggtctttaagattccaccacactggtgagtgtggtgaggcaagactaatttaaaataacataaagttttcctactttgtcaagtcgccatttcttgagccaccatttactatgtttgctgtgaatctttgactattttccacaattctgacaaagttgattctaatagttttggaggaattttgtttgattggttggttgggtgtgtgtgtgtgtgtgtgtgtgtgtgtgtgtgcatgtgtgtgtttctgtggagagatggacccctggagccccttactgcatggcattctccccactcctagatgatcttaaatgtagagccatttaatttaacccaccctagatcaatgaaatcacacatgatgtacaaacaagactgcaagaataatatgcttgtagttttaaaccactagtttgggggtagtttgttacacacatttttggagtatgagctgactaaaaatatactctgcattgtgttatgttaagagtaaacatagagtacagtaatgagaataagtgagaaaaacatgtaaccaagtaattgtatattctatccacaaattttagaatatgtaaataattgtagtttgcatttacatgctttgttatttttaacatgcagtgaaaacatacatgtttagctgcgtgaaatatgctaaaatacattgagccgacaatttccaatgtaagatatttctcaaactgagtctaggactcctaaaatatagggttaatgatggaaaaatcctaacacaagtaaggcttcaaaagaaagtgtaattaaaatgtataaaactttaaattacagccaggggtggtggcttacgcctgtaatcccagcactttaggaggccaaggcggacagatcacctgaggtcaggagttcgagaccagcctgaccaatatggtgaaaccctgtctctactaaaaatacaaaaaaaattagccaggcttcatggcgtgcacctgtagtcccagctactcaggaggctaacacaggagaattgcttgaacctgggaggtggaggttgcagtgaaccgagatcacatcactgcactccagcctgggtgacagagcaagacactgtaaaaaaaaaaaaaaaaaaaaaaaaagaaagaaattttaaattacatagaaaaatttcaagaaaacagtgcctacttcattaagcaagatgtttttttctccatgatattctatcaaaacaggcataggaataatggaaaatgatcattggcctctgtttgataaaatacccattattatgaaactgttacatttcagaaatttatgcataatgttccaagaatcagataggaaaaaaatacgttcttagtgaagcttatttggaatatctactgtttggtgcaaatacctttggctaattgggcaatttgctaccgctagtgaatttgtcaattgatgaaaagaatattatgtgaacatcttccaggcaaaatgaaatatgaagcaattattcttttaactagatcttctaaatgaagcttcctttcaactgtagtttgtgaagttctgtataagttcttttcacttagaacttctaaatgaaattttacaactaccattgttatatacacacattatgaaagcagaattggcttccactccatttctcataaaactatcaacttaaagaaattttcaagacataggcagtatagtaagatatagagaaaacaaaaaggtaaaaagtggaaggatgaagttaaagtgtagagtctttattcttttttttctttgcttgagtttgtttttgtaatcagtgttgtcatcagtttaaaataatgggttgtaagaagttattgcaagcctcatattaccctcacatcaaataacctacagcaaatacacaaataatatatagcaagatattaaaacacaaaagcagaaataataaccttcacatgaaggaagatagggaaaataaaaagaagacaacataacagccagaaaagaacaaagtggcaggagtaagtccttattgtcaataataatattgaatgtaaatggactaagctctcccgtcagaagacagagtgattcaatggataaagaaacaagacccaactatatgttgcctacaagacacatgcatcatttataaagacacatatacactaaaaacaaaaggatggaaaagatatttcatgaaaatgggaaccaaaaaggggcagatatatagatatatacttataaagaaaaactagattgcaagacaaaaactataaaaagagacaaagaatgatgataatgattgttttatataatgataaaggggtcactgctgcaagacgatataatgattgtaaatataaatatatccaaaactggagcatccagatatataaagcaaatattattagaactaaagatatagatagattacaataaaagaatagctggagtcttcaacaccccactttccgcaatgaatagatcactgagatgatattttttaattaaaaaaatttttaacttttattttaggtttggggttacatttgaaggtttgttacataggtaaacttgtgtcacaggggtttgttgtacacattatttcatcactgagttattaagcccagtatccaatagttatctattctgctcctcaccattctcccaccatccaccctcaagtagaccccagtgtctgctgttcccttcgtgttcataagttcccatcatttagctcccacttataaatgaaagcatgtggtgtttggttttatgtttctgtggtagtttgctaaggaaaatagcctccagcttcatccatgttcctgcaaaaaaaaacatagtgattgggatggtgtacaagggagctttttgatgctgtcaatatacactgaggatcagtttgtgatatattattgagtttttatttgtatttgctaaagtttttgtatgtatgtgatggtgatgtattcatgataagaaggttaaattttgctgcatactaatttaaatcttctaaaaattaaaacataaagacaagggataaataatgatgtagaaaaatatttcctacatgcaaaggacaaaggatttctaaatcaccaaggttacatctgttttcctggcctcctaaaaaccttagagctttaagctacctttctgccaatgctgaagctgcatgttagagtattgaggttgttcattattagctccataataaatgtgcagaaaatgtagagtcagtttcctcttgtctttgataagggagacatatccttctgtattccttctgtattttccactaaagttttttcaaaaagagagtttaaggagggaatacatatttaataaatgggtttttagatgtagaaaacactgagttatggtttatgcacaatttaaagggatgagctgggtaagaaagtctgtgccaggcatacaggaattggggtttagtaaaatgaaagtggtggtgattagagaaaagaccttctttacagcaccactctcattcttcttctttttcacctctgttttcacttgtctggataaggaagatctctctcccaaccagtactggtgtgtgaagaggaacagatatcagagcaaaaagtacctctgagctgtaagggctggactaattctaggacagagttagcaaaataaagttgccattaactgaaaagctgaacatcatgaataacaaatgtaccaagcgcaaacacaaacaaaaaagaaagtctatgttcaaatgaccccagagccaatatatttttaaagtagaacatcattgcaaagtggattggaacaccatggatacaaataatgtgaatattatatgatatctgtctgccaaagtatgcaaaaaaaaacctggataatctaagctccaataaacctgtgaggaatattaatgatctccaattaaattaataatattgggtaaaatagaaaataataacaatattttagaattgtaatcaaagggttttttattcccaattaatttttaaacaaagttaatgtttaaggtttctgaaaattgtcattgaatataaaatttatccattaaaatatttaaattattttttcagatattatttctaccttctactaattgaaattcctgatattgtagcttaagtcattgctagaaatggtgctgtcatgcaaaaatgtgctaagataattatgtaataaacaaatcaagaatgcatattcagctttcaacattccagtcaattatctagaacagagagattcttatttttaagccatatccagcaaaaagggcacccttttacaggatatatattatccacattggaaaaaataagtagccctgattttggtaataattcttttccctgaccaaaacacttttgaccaacatattttcatcggcaactctgaagttttaatttgactcatatataggttataattaaggatataattgagaaggattagaaagatgttaaaataaccttgtagagagtttcacaaagccaatgtcagaaagaatgttacagatcattggtggcagtcataaaatacaagtaagcattattaaagtcataatacttttaaaaattcattctagtttattcagtatttctaccttaagtaacctacactgatgatatgttttttcatgctcacagaatgacatttaaattaatgtttcagtatgaaattgttcttaatagtataaaattgaaggcagccaaaatatttatcaatagagcagatataataatattcaaatttatacaatgaaataatgcaaagacattaaagcacatacattggatctgtatgtacacatggaaagataaccaagatatgctgcccaaaaataattccagaatattatgatgtaccctccatttttataatacttctgtgtattaatatacatataaaaaagtttgggggctttttcatgaaaccattcatgattatctgggagaagagttctccagggagtttcaccgtctatgttgtatatcttaatagtatttgaattttatataaattcatattacattgtggttaggagaaaagatgaaaaaaagaagacgtcattatatttaatgtctagttgagtttgcaatatgctagtggtggagctggacagtacgttaggcagaacctatatcagattatgtccatggcacaattaggcttgtgtctttctcaaggtccacagttcgttgactttcatggaaaggcttgggaaaacagttgtaattatcttgggtccctagacctcaccttcctataacaaagagaagtaaaataattttgtctgcaaaacaaattttaaaataatgttgtggcggtgtaacctttttgaaataataattttattataatagtattttatagaaatgagagaacctcactattttaactgacggaaactattaatacagcattcaatttgcagagttaatacaagaaaaaaatgttaccaggaaactgatttatatgggcctctccacagttattatcctctgtgaacactgttacggcttctctcaccatgaattagttttgtatgacttttatataaagtaaaatttatttaaattgagccattctgcatgtgctattttgtggctggcttcattcatccatgcatgttgtggtgagaagcagtgattaatttatcttcataatagcatagtatttcttttgtatgaatatacacatgcaattatttttctgttaatggcatttgagtttcttctgttgggacatttattaaaaatactgttatgaatgttcttgcaaatgcattttggtaaacatatatgaacatttcttatgagtacatagaggtaaaactactagataataagattacattgatttaactttagtatagaatgccaaatagtttacaaagtagttatggtaccaatttacactctgaccagctgtagtaaaacttatttattttagggacaagcatgtgttccttaaatatttgaacaaattcactggtaaagccaaatgcacttggagtttggtatgagagtaggttttgaatttcagcctcaatttctttataacataaagaacaattctaatttttatttattcctactcagttcagttaaatggttttttcaaggatttattttatttgaattgtcaaattgttgtcataacattctttatataacatcttccggtaatcttttaacaatgatagaatctacagaaatgtaccctttttgattctaatactgatcatttgtgtcttctctttttcccttgatttatgagtttatcaatgttgttttttaaaagaaacaatttttgttttgtttatttcattgcttgaatgttttatatttattgtacttctgcatgtatcattttctactttttggggttaatttggtgattttctagctcattaagataaatacacagattgttgatttttagccttcttttctaatataaacaactaagtctataaaatcttttctatgcccggttttagttgcatcccaaatatttttatgtgccaactatcttgtcatttatttccaataattttctaatattcatcatgattacttcttgacctatggattatttataactataaagcttaatataaaatattaaatgatttttccatttatctttttgatactgattgttaatttaattctactctctgcaaagaccataatctcctttaaaatgttttgaaacttgtttcattgttcataatatggttaatattggtaactttccaagtacacctgagaagactatatattgtaattatacagtgcattgttctacatacgtcaattaggtcaagttcattagtggtattctttaatcctaatcaaaaccccagcaaagtttgtttatttatccataaaaatctgactctaagcagggaaaaagaaaaaaggccacacccatctcaatgtatattattactcttaggacctgggcctcacaagtcctgacttcttttattgcctttcgatgttctttgcattttatgtagcttttatagctgtttgcagtgggagggtggttgtgatataagctgctctaccagaactgaaaatggaactccttctccaaccaccgtatttttattgttggtattactatttctaatggaatgaatgaattttcttaaaatagtacaaaagaaatatattcatgggattttaaaaatcttttcttttttcatgttgcttgaatgtattgttatttaactagtgtgtttctggaagacagaatgtataataaatataaatcaaagctctttcaatgcaatgggtattatttacatgtgaagaatggcagcatttaccttaaatcattatgtttccaaagggcttgcccagctataggcagagtaaatcgtttctgtttgggagacatgttgctgaggcctaaggcaaagttaagcaagtctcatcgaacataggagtctcatacgcaccataccaataatttttctgccataagacaaagttatcatatgttgcagatatgtgtggtgattgattgtaaatttgtatgtgtttgcatgaacgtgactgcttgacatgactgtgggtgtaatatttatgtgcatacagtttgtttaatggcctatatgtggctggcttatctgtagatgtctaggaagagttatacatatttatggatagacgtatggtgtactaggtctattagcacatgtgtgtacagctggcatgggccaatatgtctctgtaggctgagtatccaaaggaaggatttcagggacctggggaggagttatcccaggatggggatatggaaggaggacaccagtcactttagtagtctaaatactagatatttgtattttttggcatttaatgaccaatacactgtgaccttttaccaaatcatttatgtttatgcccattctcctaaaaggtcttctgccaaagtacactgagaacattctaatttgtgtagcataagaacccctgaccctgccaaattcccaaattcctttcacttttcatccaatgaatctggagctccatctttgtgttcttagctgtttttcctagttcatacaataatgctttcctgaaccacaatgtctgcacctacttgatcacaaatgtgacctcttcccatatgacctgctacatccatgaactgtatcaagctaaacaccactgggttatgttataattctttagatactaatttcagcaagtaaatcatgcatttcctgcttagtcatcttcctaccattgcagtctcataatggcttccttactaccattattagcccaaaggaacttgtggttgagtccatgatgctattgtcattgacaattactagggccaaaaacagtcctatattctaagcctaaataaaataacagactattttaattgcattatataagattagaaatgatagggaattattttaaatattttatggtaattgtacatttcttactcaacttgatgaatattactggcagaaaattaaaattcaaatgtactcataataaaaatgttatctagaatttaatgaaaaaactaattattataattttgtaggagtgggaaaatccccagaaacaatttaaaataaaagattctgaaagtgctcaaatcttgtatggaatgaagattgtgaccacaaggagacattgtggatgcactgaaaacaagtcagattgaaaaaaactttatgtcctttatatagagtatcagtatattagtatcgtaagtgaatgcctttgacagtatttcttgatttcaataagatgcacaaaatgtacctaacagaatcattatggagaaaatgcaaaaacatgggctaaaaccaattaggcagattcacagctggttggaccttcatatccacagtataaattaaccaataaaagttaacctgggtcagatattctgtcaggtcgttatagatcctatgtatttggcagcctttaggcttgtctgtaaaggattttatttctccttcgcttatgaagctgagtttggctggatatgaaattctgggttgaaaattcttttctttaagaatgttgaatattggctgtaactatgtaccgtgtacagtgctaagtgctgcacactcatgatctcagcgaatccttcacaatcctgagaggcagcaaataggacatttagtctgtgagtaaactgaaacctaaggaggctacgaaactgacaacaatcatagagatagtcaattgtagagctgggatttgaaactgcgtctgtctcaggcacatagcacccaacataacacctctcataggtcccaactcatgcggcagcagcaacaataaagggtccctgtcctcatatttcttctctcttctcctattgtataacaaatttatactggataggaattattgagccaaatgatctctttgtcttaacaacttttagattctacaaaccaaatccggagccttgcccagtaccagcccagaaagtagcagaggttaggtaaacatacgaagagtaaggcagagctcacacttccactgacgataaacattccagaattgcagtagagagggtcttgcttttattttgaaggaaactttataccacacaagcaaaattggaagcaccccatgacagcatttgccaacacggctcagcacactttagcagagaataaacaagcactgaacatggaaattgggaagaagtcaagtgctatcatctccctgtacattgattcagtgctccaggctttggatgacttgctgtaaattcatttttccacaccatggtttcttgaggtctggattgtttactagctgtgtggcttataatttaagacacattaaagaaaagttatctttaaaaagaacttcatattaaaaaaataaaaagctaatcatgttgttaaaatatttgggattgaatagtgcctttagagaatgtgtatattacagaaaataatattcagtacaagcatgcaaatttaactaatgatgcatgaacatttgaatgtagtaagcacaataaagaaaatcatgaaaatatgacaaaaatgtctctcacagtcttgattgttgcacattttggccccaaaaactttaatgaggctgcagtaaaggaatcatttgacatatgttagttttcgttttcctgaaagtcacagatacaaaatttagttggctatctgggttaagtaccaatacaaaacacttttctttagttttgttgctaacatttttctcacaaaatttcattaccaagctttatttttacaatcagttatttgatgtgcctattcagatgcaagtatgacccaaaaaacaaaattacaagctgtataacatgtccaaaataaccactaatttttccaaaatgttattaaaataatccttggccgggcacagtggctcacgcctgtaatcccagcacttttggagtctgaggcaggcagattacctgaggtcaacagtttgagaccagcctagccaacatggtgaacgctgtctctaataaaaatacaaaaattagccgggtgtggtggcccacacctgtaatccaaactacttgggaggctgaggcacaaaaatcgcttgaacccaggagatggaagttgcagtgagctgcgatggcgccattgcactccagcctgggcaacagagtcagattctgtctcaaaaaaaaaaaaaaattaggtgatccaataaagtcctctattgcttaaaaaataattctccaataagtttttattaattcttttgaattttaaaaaagtagagcaaatctcactgactaaaatttagggcacgtaataactacttgataaacactaaaattagtgtttggaaaggtgaatgaaattgacaagctcacaattttctaaccacaattgccatttactattatactgatagaaggattttagtttatttaaaattggatagatattagatgccatagaaatggcccactaatttgctcaattgattgttttcaaaatccttcactaggaatttggaaaagtcatacttttcagtttattctcaatatcaaagtattcatctctctccacctccaataagttagtcaataaattttaacaaccatttctacacacattcctgccaggtcaagaagcagcattattccgtgtgtatcaatgaagacatttagtattacatactgattttattatgtataaatatgctccaagagtgacagacctttgatttagaactcttgagccgtgggtcactgtttcttctagtgaaagccaggctgctcagttatgagcttcagatgataaaaaattgattctaccatacctcaagccaataatctgacacagtatggcagcaaggtgcttatgactgaatgtctctgcatacggaccatatagcaaagaactttgtttctcacggtgcacaagggttaccacagtatgcagtgttcatcaaatgctaaaagagagttatagtgggagccaattaaaaaaaacagcctttggctcaggtttatataactcctagtctctatacaagctcctgaagaggaagtactgttgacatatttgtctttcatatcttctggcacaggttagcctcacagaggcatttagtgccttcttgtttacttgtttcactgtcttgacttctaggcagcataattgcacatgattagaaggtatctgagtttgtgacagttatatatgctgagactgccttctggttactggtaataatcagaaatgaagtggataacaaaggtagagatgtacgtgtgtgcctgtgtgtgtgtgtgtgtgtaagagagagagagagagagagagagggagagatctttcccatctgtttcaggagtacatattgttgccagttacaagaatgcatgaaaagcaagtctatccattccacttactagccagatttccctcttattggggtgggccaaacttcaatagagaaatgtatacttcataataaatgtataaaatctgaatgcaagacatggaataaaaatacatttagttatctggtaatttcactattttgaagctaaaagagacgtcaaacattgtttattccaacttcttcatgcatgaaaaagcaaaggctcaaagaagagaaataatttcccaaagtcaaacagccagcaaggaccaaagactattgacttttagttcagggatcattgcacctcactaggatgccttgcatgctagcgggtcactttcccatttccaacctcatattgtacatcagtgaactcaccaaagcaactcgagtgaggaaagcccttttctgcaattcgttgagtatctatataggattttgctaagccctgtgatttagcataatatttctaacccatagttaatttcaatcatttgtagttttttaaatatttcagataaatttttattgtagtaaactacacacaaaacaaaatttaccatcttaaccttctttaactatacagtttagtaatgttagatcattcacattgttgtgcaaccaatctccaaaactctttcatcttgcaaaactgaatctctgtctcttttaaacaactctataatttcctttcccctcagcctctggcaaccaccattctactttctgtatctatgaattcgacaactctaggttccttatataagtggaatcatataatgtttggtttttattaaagaaatgaatacacttgttttttacccacatttatgttcacaatgtcacttcacaaacaacttttctcttatccttaccctctctcgtcccaaatcctacatctacatagatccacaatgcatttaggatgtattgaacattgacataaagcttggaaggagacatgcaatggaacaggcaataaaatctagaggggagcagagtgaggattatctacccatctacctactaatttccctttctcctcctcctccttctctatctctatctctctgtttttagtttttgagatttgaagttgtgtagaagagttaaggcttatagggccacttgaaggcttatagggattggaaattggtaggaatggggcaggtgttcacagtagcattagaattaagtagggattaaatgtaaatccagactgaaaataagcatagaacttttaacatttgttgtgtgtaaacaggattggccttagaaaaaattgagaagtaaatgaagattgtgcattctttactttgcagcctttccttgctgtcatggacaagaataaattgttttccaatgatttaggagactaatgttttgctgcattaatgatgtatatttttgaaacatatgaattactcctttattcttctgcatctcagtatatgtctgcttctttccttcagttgtctgattcgaaaaacacagaaacattctccactcttcttacattccacatccagtccaacatcaactcttgctaaaatatatttaaaatataacctcatctcaccatccctactactataatcttcatccaaagcaccatcatttatctcctggattacagcagtaacttcctaaataatttcctgtattaggccattctcacattggtctaaagaaatatctgagattgggtaacttattaaaaaaagagacttcattggctcaattggctcatggtcctgcaggctgtgcaggaaggatgacatcaatatctgcctctggggaggcctcaggaagcttaaaataatggtggaaggcaaagaggggtagcaggcacatcacatggagaaagaaagagcaagtaagagagagagagtggggagtgggtgcgggacgtgccacacacttttaaacaaccagatcttacaagaacttactcactatcacaaagacagcaccaagtcttaaggaaccactcccataatccaaacaccttctgccaggccccaccttcaacaatgaggattataaatcaacatgagatttgggcagaggcaaatacccaaactatatcattaacctttttttcatacgttacctcttttggtctattccctaagccagaaggatcattttattaataaacttttattttgggggtactttcagtttcacagcaaaattggtggaaggtacacagaattcccataaacccctgctcatacgcatgcacagcttccccacttcaacatccgaaacctagagtggcatatttgctacattccattagcctacgatgacacattattatcacccaaagtccatagtttacatcagggttcactcctggtgttgcacattctatggcttttgaaaaatgtgtattgacttgtatctacaattatagtatcatacagaatagcttcactgccctaaaaatcctctgcctccctgctatttatcccttctatgctgtaactcctggtaattcctgatctctttattgtctctaattttctcttttacagaatatcatatagttgtaatacagtatgcagcctttttaaattggctccttttacttataacatgcgctaaggttgctctatgtctttgcatggctttaaagctcatatttttaacactgaacaatatcccattgtctggatatacccccgtttattcattcacctactgaaggacatcttggttgctctcatgtttcagcaattatgaataaagctgttaaaagcacctgtatgaagctttttgtcaagatatatttttagctcatttggccaaataccaaggagaacaatctggattgtattttaggagtatgtttagttatgtaaaaaactgccaaactgtctacgaaagaggttgtaccattttgcattcccacaagcaatgaatgagaggttctgtttatccacaaactcaccagcatttggtagagtcgcagctttgaattttggccattctaatagatttgtagtggtatcaaattgttttaatttgcaaattccctaatgtcatttgataacgaacaacttttaatatgtgtatttgccagccgtatatattctttggtgaggtatctgttcagcggtcttttgtctatttttaatgaggtagtttgttttcttattgttgagatttaagagtttcttatatgttttggatgagttctttatcatatgtgtcttttgcaaatattttcctacaatctttggcttttcttctcattctcttgacattgtcttttgcaaataagaagtgtttaattttaataaagtccaggttatcaaatatttctttcatggatcatgcctctttttttttgtttttttttttttttgagatggagtctcactctgtcacccaggctggagtgcaatggcgcaatctcggctcactgcaacctccgcctcccaggttcaagtgaccctcctgcctcagcctcctgagtatctgggattacaggcatgcgccaccgcgcccagctaaattttgcatttttagtagagacgggggtttcaccattgttgcccaggctggtctcgaactcctgacctcagatgatccacctgcctcagcctcccaaagtgctgggattacaggcgtgagccactgtgcccggcccatgcctttatttttatacctgataatcatcgcggtactcacggttatctagattttcttatatattatcctctagtagtttttatagttttgtactatacgtttaggcgtaagatcaactttgagttaatttttgttaaaggtgtaaggtccatgtctagagtcatttttttcttgctgtgtcaatgtttcatttccagcagcatttgttaaaaagactatctttatgagtgatgtcagcaagatgaaggaataggagtttccagtgttcatctccttacagaaaccagtttgaacaaccattcagacacaaaaagaccttcatataaactaaggaatccaggtgagacattacagcatctgagtggagcacatttaaaaaaataaaagtagaactaccatatgatgcagcaatcccactgctagttatatatcgaaaagaattgaaattgggatctcagagagatattatcactcccacgttcattgcagcactattcacaatagctaagatgtggaaacagcctaaatgcccatggacagatgaatgaatacagaaaatgtggtatatgcatacagtagaatactactcagactttaaaagaaggaaattgggcaatattacataacgtggatggaccttgataattttatgctaagtgaaataagacagccacagaaatacaagtactctatgattacactgagatgaggtatctaaaatagtcaaatttataaaatcaaaggctggaatggtagttaccaggctctggagggagggaaaatggcaagtaattatcaacaggcataaagtttcagttaagtaagataaataagctctaaggatatgctctgcaacattacatctatagtcaaagataatacattgtacatttaaaatttgttagaagaataaatctcatgttaagtgttcctaccctagtgaaataaaaattttaaaaactaattttaattcattttaaaaatctaatgcactgcttttctatgctttactatagataggaatcacctgggatcttaataaaatgaagaatttggttttagtgcgtcagaactggggcttgatatttttcgcttcttaaaaacaggtgatgcctgtgcagctggtccattgataataaattgtatagcaaagaatttagcagtgattctcaaaccttactgctcaatggaattacctggggagtttcaaagtaaacagttatcttcatcctactcccaaaggttctgatttaattggtttggagtgtggcccgggcatcagaaattttagaaagatcacaggtgattctaatgtgaagccaagggtacaaatcacagtccttttcactcctctgtggaccaggatactttttgtgatgggtagaatggaagcaagttaggaattactattttaaaagctgcagagaaaactgcttttggtggagcataatgacatttgaaataaggcaggagcaacatctgattctaggcatgcccagttctactgctagcatgctaggatcctactattgtcaattttatcccagaaccattcatttgggagttagaaatgcagaatctcaggcttcaaatacaccttttaataagatttcccaggtggtaatgggacaaattaaggtccacgactcactacagatacacaagctaaccaagcagctcccttataaaggtcttggaagcaaaaaggagaaaaagaaaaggatgcaatcaaaggtgaatgagaaatgctaatgtagcttttcaaggaagtgcccaaatatacccattatacacggtaagtttcaaatctgtcaatcaatatcaatttagaggcatatatagatataatttctttaaaaggcaaaatctcacttataaaagtgaagcaaggaaataaagatttcatccggcaaataacttcaatataagaagctgaatgatcaggctgttagaatagcagagtggtctcaagatgtgcaagttgctaagaatgtgtatgcagctctggggtataaagttcattttcttagtgcatgcactaaacactgctgacagtattgtaaaaaacagtccagtaacagctcagtgtctactttttggttctcattagtgttaaattgtcgatgtgcaggaaccactaagtaagcccttcaagatgatggtattgtattaggcactccacagagattaatctctggctttaacaacttttgagtgtaatttgcaattttcaaaatgcacaattgtaaaaacttcagagaagttggttgtcatttcacatgatcaggtttagtccattggagctgttgaatctctgctaaggaaaaccaatgttacagtatggacacaggaaaccactggctagccttgggcattgatgggatccttgcgttggaaagaggtctgttaactctcacagccagggctctatggccaggtgtacaatcgataatggaggcagttcttggaaatatgaaagctgggaaaaagtagaggtgtgttggtgttggcattcttaagttccctacctcctattcaggcctgctctagttcccttgtctctgaggtccagaacataacttttaagggtggtacagggtgcttgaagacagcattcaacctttcagtaacaacagcctatctaaaaattgaaagcaatgaggtttgccaatgattgatatatggcattctcacttggtttttctgccagatgttcaagtgttacatcatgttctgaggaaagcctggagtctggacacagcaatgactttttagtttatttgctttcagcatgtagcaacagatttcaatttatatgtactcaagtatgtgattttatcatcttaaatggtagaatctttgcaatattgtatactgggatggggtgtgggcacgacgtcttttgttccccactgaggttcactggtcaactcctgacaagtcaccaaaaaattaattgaaaaaaattagacgtataaactttttttaaataaaatgatttggagttaatttgctgacattttcaatgatgaccagtgattgtgagtagttgctgcctcaaaggcatttaaagacacacacacacacacacacacacacacacacactctcacatctaatctgttgctttaatgttaagtgggtttttgcaaagaacaagaaagtagttggtgttgaaaataactcatgctatctatagagtattataaagagaggttttctcttttttttccatttctaggttgctttgctgctgaaagagatatgtgtcacctataaaaactctgatatctggtcactttaaaaatcaggcttcagttttctaacttattcaaaaatctctccaaagaaatgtttcagtgacttttcaatgtctttgataataacataaatttcctttgataagtttgcaagcacatctgattactcccccttgtggaacattgaaatttacttgccaaatttcaattaagtcctttcaatatttagtagttgggatttcaaactcagtgtcctcattaagtaagtgcaaccaatgatactcttcttccataaagatcaattcacctttctagccacgacagctacgaaaaccaagaatcaaaatgaaattaacgtagaactatgttgtaccatttggatattgtgctattaatggaatatcaaaaggttaaaaaataaagcacattcaataacattgccaacaaaaagactttgcgctgttaatacagaaaataaaaatatttcaaggtattgtttatttcatctttagcctatttgtatttatatattttgtatacatattgtatcagtagtgtatgtatataatttcatacatactttgtatatacaaatatataatatataaaatttatatgtaagtatatttatataatttatataaatatatataattatatatatatatgtataattcccctgaagaagactgattcataggaaataatcaaaacacacccttatttttgtctcctactgtccttttgaaataattctgtggaggaaatctcttcttctgccactgggtaaaaattccagtagagaggcagaatacattctctaattattcttatataacagaagttctaggaccacttttagttgcaaatattcagtctggacttagtatttagaaaagcttcagtccaatttatgactcatcaatttgaactttattgaaaccagtatggaacaacccatctgcctttgaagcaggggaggtgtttgatcagtttcttctgtttctctagatcctatttacctttactcactagtgctgtttgtgacattgccaatgtctaatggagtttaaagagaagagagagggacatagggaagttcttaattcccttatactgtaggagatggtttgctctccctagacctggtagcggtttactcctcacttatatctcactgacatagtcacatatatcttgggatataaccatatacatatcaaagataactatatttatatatagtatatatgtatatatgtgaaatacatatttatatgtataacataaatatatattaataatataatataaattattatatataaattgtgggttcttcagagtctgttctcctggatcccttctgaagttctgtgatcaacatgatgcattctgtttttccagctgctgttacctcttctgtttctattttttctagctgccaacttcaaaaaaactctctcttttggagtgtgaaacccgaaaccaacttaatttcctggatccgtgtaaaataataccaggactgagtacactttactatctctgtgttaagtaatgctgagaaataatactaagaacaagcaaaaataactcaccaatttgttccacaaaatgttttctactgcaagataagaatgtgaaaagaatagtatacttattttcaatactaacagattgctcatcaaggttcacttccagatctcacctctctgtgtctcctaatctaaagatactctgtcataacctctacctagtcccccataggaagatctatcacctcagcaagatctatcttcacatcactatacccaggttctaaaatcctatgcgtattttcccctgactttctcagttctgagaaagtacgaaggctcagtcatgttctcccttactgcagtgagcgcgattgatttagttgtgctcgatcaacatgttttcggtgatgtcttgaagttgattttggtcagtacctttactttcccaagtggttttcttggttaaaactctaggtggctctcgctccctcttaactgaggagaagactctgaattcacagattccatgcaatattcagccagctgcaggcacagggtctggctccctagtagtgagagtgaaggaatgctgcacacagtgggtttgcatccacatagacttcatctgctgaacacccaacagctgtttctacaagctaaagttgtagcttctatcactgtctaaagctgcagcttgtatctactattgtctctacaccattgcccaaacactgggtaaagtgctgttgaatttgtcacccccaggcataattttgtatccaaatgtaaaggttgtgggttcagtcagtctaaaaagtctaataatttcttctctcagtccttcccttctcccttgtctgaagctgccaccaccatttagaagcctccgatgctgtttattcccagctgctcaacctcagagtgtgtgggaaaggcctgagagagaaaggtatgttttctctcctctggagtctctgtggtgttgacacagcagagaaagaagcgggagcagcctcgtcttgcagaatcaccttcaatcactgctactgtctgggccgttactgcccgtctggccagtgtctcccgcagtggatggctttgcctccaggggtggaccagtgtttacctgacttctgagctctttaagctgcctcaaagaatgaatctttttagtctagaaaatgtgtttatttgataaatatactattgtgtatgagtgcgaaacaatgcaaacttcggagtatctcattagaaggactgtatgaatttataaaaaattgaatctaatctcagaagagcacatcatcttctcagtcgacaaggttgcccagccacagaggatcagagaatgccctttcccctcccgactccttttctcagaatcctctctcaggcctaattgagctgtcatatccaattcagactgatacagagtgaggggcgctgagagtctctatgtatataaagatataggaagaaaataagaaccatcacgggaatgtgttgggcttctccccatgactgtgatcttacccatgtttgattcacaaattttaatttataacagttatgattcttgctgttttcaagtaattcgttaaatgcctattcaatgcaggcagatttttgttttcagctgtggcttgtaaatgtctacaaactgattcacgctggtggtcgttacgacactttctgtgaattggtgaataaatattgttttagaatttcacagtaaacaagaacaacaacaacaaaaaactctaggtggctctactgtctcttacttttgattcatgggaaacacacatctcccttcaacaaattctgggtgattctaatacagtcacttctcctttgctttcccacataataacttgccattccatctcacttgtctttgtgatttcctagtccatagtgagaatacagttctctgtgactcttaaaccttaaggaacatatatcataatctcagtggttttattaaaacccttctccttaggcttgaggtgagatctgaccgttcccacctattcaccttgagatcagtggcggtgaataggtgagatcacagcataacaatagcttctccaaagaaatctcacaaatgtactctgacaaatctgttcaactctttgatacctttaaagtgtttcaagtttggaaaaaattccaacctctcattttctttgaaaatttgcattttggtccagcaacctcactttggaatatcattgtatattcattgaatatcattgaatatttggatatctattgtatcctggcacctcagtcaaaacttccaatgtgactgttgggttttcaatattcatatttattcattttatcctgaaagcacagaaaaggtattccagatcagagacaaatttcctaattataagttcatcctctgctctaccttgcctcaggctttacctctggggttacacaataagaataaggccaactgtcctacacaagtagccaagcattccataggcaagggagaagatgatgggaaagatatttctctttgcttataaagaggaagaagcagctcttccttacccctcttgaaagggtgttcttggaaaattaattggtctgaatcctaactccaattcactgatatgtaaataaaatgtttgcaggagccagagggctacatgtgtctcagaatttgggacctagagatgtctgcaagttctccagcctcaatactcctggaaatgtaaatacccaaaggcatagctattgcagtctttcctgcaccttgggaacttaacaaggggacctagtcaggtatgcaaacatttagcactctaagggagttgagagatttttattaccttttcagaccagatcaattaactaggcaaatgactacagatctagatctcatggtatgtaaagagtaaagtatttctggggaaaataaaagcaaacattctctatctttacatcatatacatttctgtgtctcagaaggcaggggattcttgaagaagcacgaagaaattcagggaagttttcttttttagcagagacattctgctacattcatattttgggagcacatatattaaatgtttgttttattacaaagcatgtgctgttaaaaataatcttgtgaacaactgatctagtccagtgcttctcatactttatgcttaatgcacagacagaaccatcttgagaatcttgtgaaaacatatataagcagattctgattacataggtgtggagtgagttcttagatttgttatttctaataagctcccagcagatgctgatgctgctgttcacacttagcatagcaagaccccagccacctccctgtctccagagttggagcagaactgtgaactctctgagctggaaaaattgaaaattgtacagcagccagaatgcatctctgtgttgcctaagcaaggagcaagaatctgggtcaagtgttggacagaatattagcacttgttaaaattgaaatggagtggtggagaagagacaggaggattcaaagaatcctggttgaaaaaattgagatacagtaggcaggagataggaatcagtcagaagagcaaaagaaaatagtggaaggaagaacacagacaaaataaatacagtctagcatttccagcccgtgtttcattgggtaaatatattgccagatgtcagctttgctgtgcgcctaagcaatgtgatggtctcaattttttgatggttattaaagaacttgagaaggtgggagatggtctggtaattgggaagacatgacccagcctaggcacagcataacaattgttttcttcactgcttgtttccatatccagtgttgttatgccatattttggaaattttccttgggaggtattcaaactgatggtagaagtattgcagaagtttgaaaaaaataggattataaaaaaatccaacttacaaagaaatatatttaattattctgtaagtttgttagagctagaataatttccagtattttccttttcaaaaactgttcaccatttttttgttggtttagataatacagaggtttgggggaggatacagatgtcagccgttttcagcaacattttttcagtaaatctgaaatgtctatgagccggagtttccattgccagaatctgctgtccaagcaggaactgaccatgttctgtcaaagtctccctcaagcaacagtgaaagtcagagcatcccacctatatatcatatgacctgcttgtaaataaatgtattgagacaaattgttacacgaagcactttgcaggcactgcaataatcaggggtgactgaatcagtgtttctggtccaaaaaattgaaaaagaaaaattttaaaagattattttttagtctattgactgaagttaaaaaaaaaggacttttacttctcaactttaaaaatatttacaatgattttatttgtaagagactgcagatggtttcagaggtttactcaccttcttgaaaggagaaatgaatttgacttttgctaagcaacatatgcactttccacaagccaagactaccatttactgtctaaattgtatgtcctttttactgtagacaataattttcccagtagtgtctttatattctggttcatccttattatcatttctgtctctcctactgggaacagattttaagtagtttcatgataggtaaaaaaataaatgcaaaagaatcatgaagattctttaaaaaaatcttgaaccttaataaaattgttgagacatttgtgtttctttcccacaacagcaatacaaatcttatttagtctaaattatcttcactttccttaccagtctctgaattgcttaaacctgaacaaaaacctcaaagccttaccctctcagggttttagaaattgagtatctgactctgtttgggaaggatgggtttggcattgtcttagataatggttttaaccctcttctacataatggcacacaaaaggtttgaaaggaggaaatgaaagatgaagcaatcaatagaatgactgtccccattaaatcaattagaacattgaactttcatttttccttcatttgatgattacaggctttttactcatcctgcctgtctgcacttttgaagtacaatcttgtcacagaatgatgacttttatcattacctgaaaaattattaaagatttagtgcttctcagcattatcaaggatattcaatcatgctaatttgaggacagtcctagaaagggcccttttgggatagatgtgcatctccaagtcattgtaaccaagacaacaaacatatttccaatctatgcccatataatgatccaggttaataaaaactgctggcttagtgaagtttctagaagatacttattcacttaacgttaggtaagcctcaggctcttagtaattcttagagtgttaggtctttagctctcacaaaagtgttaatttcttcaatatctctggttcaaaaacaatgaaaccaccttggaactttggaattttgctctactctgttaatatacagtatctagcttaaggattgagaacatctgtaaagttaaattggatgggtttgtaagaaacatattagtaatgctgccttttgatgcttacaaaaggcatgcaaaagaaagagatttcctgcccattttcaagaatagtaattgaattgaattgccatggcatgatattggaaaataaaggcatctacaagaaatcatgtttaccataatgtgcatctccccagatcagcaaatacagttatgttgaattccgagaagacaaggcttacaccctccacaatgtgtagttcattcccccaaacgtatacattctcaatctgttctctgcctaacagttataaatataaagggaaatctgactaacttagcagattttggtcctaacttgcccttgagagtcactgatttgcttaactttaacataaatctatgcattttaaaactttgccatgaggttcatcctttcatcattcaacttaatacaacagatttcatattcttgtcaataaggtatgaggtatatatgaaaagacagagcagggtagtatctattaaatgacagatgagcaatgctgacttaggaatctatatttcttttgaacctgttctgactcagaattattattctgtaaactggaatctctctgtccttgcctgggttaccctagtatgttttttgtagtttctggcatccgtaagttctctactgttcctaaatgtcatttagagacatggtgttaatttcttttcagcacttctctgtattctgtgcagaacaagtgcccctaatgattctgtgaagaacaagtgctcctaatgattcacactcaatgctatccttgacagctgggtcaaattcttgaactactgagaattatcagttttctgcatgcataggtgactcaaattctccaataaatagttttcattgtatagcctgacttgttggcaatatacctttttctttagcaacttcaataatagaaacccacaatgtttttaataagcctatgtcagatgcttaacaacattttgggtgaaactaaaatcattcaaaacccaaaagtggttttatgagaaatggccaatttgagcatgtgagcatatttatgagaaataataaaagtaatagcattttggtatagaattctaaataaaatccaccataagatatttaaaagtgtatgtaggtttatttgttttggttatggaacataatggagcacaatacgagaagcacagagatcacagttatttattatggttcaatggagaaatattattaaagtagcagggccacagccagcagaattagcaacaattgtttatgataagtacccaatactgcattggaactcatatgctttggactgggactgtactgtgaaatttcaataatatcaaagaagatcactacttgacaggtatttgtagttaagtggcacgttttctagaattaacttactaataatctttattggttaatatataactttgttatttgaaaacccactgctttttaaaaattatagctacataagctcttggggttgtgtcagagagacaattttgagtttaaaaggtggattgataactaatgataactgacaatcaagaagaccttttgaatttctttacccttagcaccatgcaaatattgagggatgtaagatccattctacaaccaaagatttccaactctcttgtattatcttccaatattaaaaaggttttgagagaagattctaaatgagtgactcagtgatttgttttagtcctataaaaaacatgtaatatacatcccaattcttcacttaatgagagaaccacatattcaaaatattaagccacttggatgaatgtaatattaatgacaaatttagatgagaaaatggaagactaaatttttagtcagggtattatgagtgtaagctgggatgtaaagcaattaagactttagctcctttttactgtcaaaatcagtctcctccaagaatacgatcagaaagaaacaaagggaattgactctatatgacagtatgtagtaggactcacaaaatggcagaaatcaagttatatcttaagaagaactgggttgagcaggcaagccaacaaggtggaggaggccaatcagcattcaggatggccaaatattaacaaaggaatggtaaggattgaattctagacaaggtaaacaacatggaaacagaaattaatacagtaagaacaacatgtcatcatagaatgatgagtatttgagtctagctggattaccaggttctttcaccagagtagcaggaagaaattctcttttacaactcttaagatatgactgtcagctaaaagaagatgggcacaatttgtgagtaattgattgttgttccagcaaacaagaggcattctcattaaagtatttcaggaaagtaaatctgaatgtataaaagttgaagaaaaaatggcaaagtaagggctcaaaaaaagcagtcccttcactgaggtacctgtaagctggaaaaaatgcaaaaatttgggagctctgaagtataataaaagacttacatcaatcgtgagattgcttaatgaataaacaaaatgtgaaattttggcaagaaagtattgtatttctgcttacctgccaaccatctccaattgcccagcagtccatacagctggcagttcatgatcctggtgtggcttgctggtaccaatacagacctgttttttgtttgtttgtttgtttgtttgttctgagactgtgtctggctctgtcactcaggctggagtgcagtagcatgatcttggctcactgcaacctccgcctcccagactttttgatccaccatcattatttctggttcaccagctacactgagtcccttgtcaggccagccagatcccagctcatgcctgtgccacatggaaattgaggttgcttcaggaaaataaaacttcagggcttacctctgtcacatccattataaggccaagttcctaaagtcattgctcaaggttggtatgaaaacagcatcccaagagtgaccttttcttggctctctcaatggaaagtaaaagcaatctcctcctccttctatactttaatgtaatcattccttatcataagtatctccttcctataccttgcagcaacaagtgagaaaattggtgattgctttcttcttttcctctctcacttcttttttcctcctttcaaacatttcctagccagatacaggcagtatttccctattcttcctctatgctctattttccttgtaccattgggaagtacaaacctaaagtcctacatggatagggtaaggaataatatattcgcttcaccgggccaacacttcatagtctacagtttggaaaatactttgaaagacaatactagctttgcaaggctgccatctagtggcataatccaatttagaatattaatgactatcacttaggtcttccataaccagttacaatcacttctcagacagatgaatgcccagggaaaattaagtcaattgtagtttacagacgaaggaaaaaagagactaatctgttagttcagtgagaagtgattgataaacacatttggataacagtgtcaatttgtgacagtgaaacagcaaccaggaagaatactagtatttctgacattgattaccctgatatgttatatgggtctgagtgtttgggttcagaatgaggttctctgatttgttctaccacaagatagatatttgattgataactctgagagggaaagtactatacaaaggctctcagccacaggaaaccttatcctttaggatgaaaggacaaaatagatagagatgatatattttataggtacatttttgaatttattaagaattcccaacctatagtcatctccatttttccattgtgcagtctgattcacttgccctctaattctgtattgtatctatcctaaaactgtgagaaaaaaatgccagatataagatgtgagcatttccataatcagagaagagaactgaaaatcttaatgtctatttaaaatgctctagggtctttaatagaaatgctaacataacacgaagtatactatcaaacatatttgcacactaaatattccctaatgttgtacaaataccaaatcttaccagaaactgatttatattccacattattaaaatctcatttttcccacttcattaattatttcaaaggcaattttcacaagcatgtgactataaagtgcttgtatttttatcctccttaaatacgttctaaagtttagcacagggggaagtccctcctctgtttgaaattatatatagctgtgcaaaacaaaataatttgaatattttcaaacaggacatattaatttaattaaaataaattaaattccatactgtaggattccaacccaatttgaaacttgccattcgatgatcaaaaatcaatcttgcttcaaataaaacattaacttataggttaacaatagaaaaatcacttaataccagttgaatgatcaagttacattcaattgcaaatgaattgtttatatatacaaaccatagaatagtattgatttagcaaatgtgcttcacttcattcaacttatttacatacacatgcacagaaacagcctgtaaaatattcactaatactaagtatgtatttaacaaaaattctattaagtattattatttctgtaattctcatgacccctctaactgtagaaatattttgaatcttgccttaaataatggcaagtttgtattgttgaatgttttcaaggattcaaatatcaaaaggcaaggagtactgttttaggcagcaatttctcggaagcatggtcatacggtacagtagttatgcaagtcaatctgttgactctccagtaatctcatacgcctacagtggcactcaaacttttgattcttggaatcatgccatgaataaattggtctattgagcaaaatctatgcagccagacagatttacatttaaataaaatctgaaatcaacttagttcactcagcatagcagtacctggtcctcagtggtgtgtcttcttgcctttgagtatcagtcaagagtagcccctctagaactaaaagcagtgaaatggcaaacttgcaaaaacctgaattgattctagaaacctacagatcaagagaaacctttaaccattccagaaacctgaaatgacatcagaaagcaacagatccagagaagcttttagccataccaaagttttaccataactgactaggagggaaaactcttattaatctggatattgcatgttatccccttgaaacacaatgttgagacagaatccagcaatattgtcttaggagaaaactttcctaaggcaaagcacaatgacaacagatatagagttactggtcattatattgtatgctgtgtggtgaagtttttatgaggaacataggcttagaataatgtatcttgatgcaggtaaaaagactaataagcaatttgggaagcctagcagaggaaaagtagccatccaaaactggaactattaagtctcaatatcacagaagcaagatgagtgtacggttttaaaacatatttgaaaattctttgacaagtttcctatcaagagatgggaaaaatttcccaccccactactttttaaatatagactggccttagtgaccaaagtctaataaaaagattgcagctgaagtgacattgtgcaacttctgaggttagattagaaaaagtaatactgcttctgactggctctctcaggacatttgcctttggaacaaagatgccatggtgtaaggaagacctagctacatagaaaggccacacgtagatgattctattgttagcccctgctatgactccaaccaaaaactaacatcaaccaccagacatggcagtaaagaaggcttttagaagatttcagctccagccactttctgagtgcagcagcatgagagacttcaactgaaatccaccaagctgagctcagtcaaaccccaaaactataaagagataataattttaattgattgctattttacaccactaagtatggatcaaattgttaacccagacatgataatcaaatcaatgggacatgtgcaagggtagtaccccttagaagtggtttgtgtgaatatttttgctgctgctagcatgtttccctagtttcattgaaagattaagacaattctcaagtctctaacagagacactgaaatgtaattcaagtaaaacagtatgagattgaaaataatggccatctgctttgtctactattttcatattataaagtgaagtgatatgtataaaatttaagagatggaaagctaaagaagaagaattgttttatttgtgaaagtgtaacctgaccatttgccataaatattttaggcaccttgacaagtatagtctttataccagtataaatcaggtatattcacatatgatagcattatagaactaaccactcaatcatgttttgcctgttaatttgtatatttataccatgttgttccaaaaggatttgagaaagctttaaaaaatatagaaggttggtgcctcatatggtttgactctgtgtccccactcaaatctcaactcaaattgtaatccccatgtgtcgagggagacacctggtgggaggtgattggatcatggggacggtttccccatgctgttcttgtgatagtgagagatctaatggcttaaaagtggcagtttcccctgtgctctctctctctctcctgctgccttgtgaagaaactacctgcttcccctttgccttccgccatgattgtaagtttcctgagggctccccagccatgcgaactgccagccaattcaacctcttttgtttataagttacccagtctcagatagtatctttaaagcagtgtgaaaatggattaatacaatgtcggtatcaaaaaaaaatcaaatgtaacccataaatataaaaacctattatgtacccataataattacaaataaaatatttttaaagtttatttaaataatatagaaggttagaaaataaaccataagcttaaaaaattgtaccaagagaaaacaaaaaatgaagaatgatgacaaagtatacccacgaattaggctaaaattaatcataactcagttatgacttatagcttgtgggaaatacatttctaacatttaatataaggtattaaatttatacagtttcataatttaaaagattggccgaatgaaacaaaataattactcaatagcactcaatccttgaactacaaaagaattttcccccttatggggagtgtcaaaaaataagacatgccctataatgaacaacatattttcaatgattacattgacatgttccagagtacttttcttccgttgctttctgtctttcttttgcttttttcttaaggtttaaattacataagtgatgcctttttattgaaaaaaatagagaattttataaatgaaaacttaaaaggaacctcttcatctttgccactaccaacacttcatttgaaatgtctatttaatcaaacaagaaattctgcacaaattatttactttcattgaaataatggccaaaaattctgaattagctgaaaactataacagatctgagaaactcaacaaaacccaagaaaaaaaccattaaagtatatcaacatacattataatcacattgctcaacaccaacaataaaaagacaatcttaaaagcagccagaaaaagagatctgttacatagagagtaataaacttagggatgacagcagatttgttattgaaaaccatacaaactaaaaagcacagagaaagagaaaccataaacccaacattttattatgagcagaaataccattaaaaacaaaggcaaaatgaagactttttttaccatgaaggattgaattgacatataacaatatatttatatttaaagcatacactcaattttggcatatgcatgtactcatgaaatcaacatgatcaagacaatgaacatagccatcaccctcaaaagttttatcatgcccctttgtaatctctccctattcccataccctttctttagcattcccagacaaccactctttggttttctgttaaatagcttgcatttcttataattttatacaaagagcatcacataaataggaaataatcagttttttctgtttttttattcactcagcataattattttcgattcattcatcttgttacatatattagtagctcatcctttttattatggagtaatattttgttgtacagatataccaagatttgtttactcattcacctgttaatgtgcattttggttgtttcaagtttttgtctattaaaaataaacccttgaccaggtacagtggcacacttctgtaatcccaacactttgggaggctgaggcaggtggattgcttgaagccaggagttcaagaccaacctgggcaacatagcatgactgcgtctctacaaaaaataaaaataaaaaaattagccagctgtggtggtgcatgcctgtagtcccagctacttaagaggctgaagcaggagggtcgcttgaacccaggagctcgagggtgtagtgagttatgatcacaccactgtactccagcttgggctacagagcaaaaccctttctctaaaagaaaaaaaaaacctctgcaaatgaacatatgcttttatttcttttgaattaatgccttaatgtggaatgtatggatcacatggtagccctatgaggtggcctaggcctggtgtctccctctttgacccagaaatcccattactaggtttatacccaagagaatataagtcattctaccataaagacacatgcacatgaatgttcattgccgcactattcacaatgacaaagacatagaatcaacttaaatgtccatcaatgacagactagataaagaaaatgtaatatatatacaccatggaatactatgcagccataaaatggaacaagatgatgtcttttgcagaaacatggatggagctggaggctactgtccttagcaaactaaagaagggacagaaaagtaaataccacatgttctcatttgtaagtgggagctaaatgttgagaactcatgaacacattgaagggaacaacagaccctagagtctacttgagtgtgaagggtgggaggacggggaggagcagaaaaaattaactactgtatactaggcttaatatctgcataatgaaataatgtgtacaacaaagccccataacacgggtttacctatataacaagcctacagaggtacccctgaacttaaaagttaaaaaaattaaataaatggtacatatgaaaactcattttcctgtatcttttaatagtataaaaaattcaatttgactagctcctatttttgagctatagaagccttagaactttaaacattactacagagggagacaccaggcccaggccacttcacaggaaatgagtacttttcaaatgcacaaaggctgaaataatcagcgaaagactggcactataagatatacatacataaagtggtacatttataaaatatgtctgtcagactttcataatattggttgaaatggaaatggacttggagatattgacttaagattcatcatcatagacatggctgatatcatagatggtagggaggctgtggaaaataaaaaagaggcacaaagtgaaaagcatgggaagaaccgatgatgcatgagagatttatttgatgagtgcctaatgtacaaggtaccatgcaaggtgtgtaacatactttatctcatttcccttacattatgcctatgaagtagatataattattcctattttgtagatgagaaaactggaactctgagaatttaagtaaatttcctaagaatacactgccaaaaaatggcagaaagaggatacaaaatgaatgtgcaaaaaacagtagcatttatatatgttaacagcaaacaatataaaaaaaaagaaatgaagaaagcaatgccatctaaatagctgcaaaaatataaagtatttggcaacaaatttaaacaagaaatgaaaggtctctgcactgaaaactataaaacatcaatgaaagtatttgaataaattcacaaaggaaatggaatatttcatgctcatggattcaaataattaatattgttaaattgtttatatgatccaaagagatttacagattcaatgcaatccttatgcctgtatcaaaacatcccatataccccataaatatatacacctactatgtacccagaaaactttaaattaaaaaaatttttaaaaatactgagattcttcacagaaatagaaaaaaaattctaaaaagtatcacaaaagtcctcaaatagtcataccaaatctgagcaaaaagaacaaagcaggaggcatcacactatctgacttcaaaatataatacaaagccatagtaaccaaaacagcactgtactggcataaagacagacatttagaccaatggaacagaatagaatacgcagaaatatatccatgcatttatagccaactcattttctacaaagatgtcaagagtgtatattggggaaaggacagtctctttaataaaaactggctaaccatatgtagaagaataaaactagacctctagccctcaccatatagaaaaatcaaatcaaaataggttaaagactaatcaaatcaaaaaacctgaaactatgaaactacgaaactacgagataaaaacaggggaaatgctctatcatgttggcctggacaaagagtttttgagcaaaacctcaaaagcacaggcaaaaaatgtaaaaaaagacaaatggcattacatcaagataaaaagctttagcacagcaaaggataaaacaaagtgaagagacaacccacagaatggaagaaaatatttggaaactatccatctgacaagagatcaatagtcagaatatattaggaactcaatggtaagaaaacaagtaatccaattttaaaatgggcaaaagatctgaatagacatttctcaaaagaagacaaacaatggccaaagggtgtataaaataatgctcaccatcactaataatcagggaaatgcgaatcaaaaccacaataaaatattatctcaccctagttaaaatggcttttataaaaagggaattagtgagtctggcaaagatgtggggaaaggagaaccttcatacacttttatgggaatgtagattagtacagccactatggaaaacagtatggaggtttatttttaaaaaagaatctaccatatcatatgatccagcaatcccattagagcttatatatccaaaagaaagtaaatcaatatatcagagatgtctgcactcccatgtttattgcagcaatattcacaatagccaatatacagaatcaacctaagtgtttatcaacagatgaatggataaaaaagtgacatatatacacaatataatattattcatccataaaaatgagatcctatcatttgcagcaacatagatggaattgggggtcattacattgagtgaaataagccaggcacagaaagacaaatatcacttgctctctctcatatatggaccctataagagaggacttcatgaagatagagtagattggtgatcaccagaggccagaaagatttgtaaggagtaggaatgaagagaagttgattaatagatgcaaaaatacagttagatagaaaggataatacctcatgttcaataattcagtagggtgattttaataacaatgttgtatacttcaaaataactaaaggaaattaattataatgtttctagcatacagaagagataaatgtttaaattgatagatatctcaattaccctgatttgataattacacattatatgaatgtatcaaaatattgcatgtacctggaaaatgtgtaaatctgttatgtataaatacaaattattcaaaaataaatttaggaaaaatctcatttacaataactacaaaaataattaggaatctattgaaggaggtgaaagaccactacaatgaaaacaatagaacaccgatgaaagaaattgaagaaggcacaaataaatggaatgatatcccctgttcttagaatggaataattagtattgttaaaatgtccatactacccaaaaggatctacagacacagtgcaatccctattacaattcaaatgactttcttttacaaaaatagaaaaaacaatcctgaaactcatatagaaccacaaaagatcctgaataaccaaagcattcttgagcaaaaagaacaaggctggaggcatcacacttcctgacttcaaaatatgctaccaagctatagtaatcaaatagtgttgtactagcataaaaacatatacatagaacaatggaatagaatagagaacccagaaataaacacatgcatttatggtcaactgattttcaacataggtgccaaaaacacaatggacaaaggactatcccttcaattagtggtactgaaacaacttaatatccacaggcagaaaaatgaaagtagatcgtcatctcacatcacgtacaaaaatgaaagatttaaatataagacttgaaattataaaactactagaagaaagcatgggggaaaagttctgtgacattggtctgggcaattgtttttttttttaatatgaacccagaagcacaggcaacaaaagcaaacatagacaaataggattacagcaaactaaaaaggttccccatagcaaaaaaacaaacaaacaaaaacaaaacaaaaaacagtgaagagacaacttacggaatgggagaaaatatttttaaaccatatatctgataaaagactaatatccaaaatatataaggaattcaaaaaacatgaaaacaataaaacaaataacccaattaaaacaatggttaaaagatttgaataagcattttttaaaggaaggcacacaaatggccaacagatacatgaaaaaaatcatcaacatcagtaatcatcagagaaatgcaagttaatactacaatgcgatgtcacctcacacctgttagaatggctatcatcaaaacaacagaagataataagtgatggagaggatgtggagaaaagggaatctttgcacactgctggtgggaagataaattagtacagtcactatagaagacagtatggagattcccctaatactaaaaatagaactaccatatgatccagcaatcccaccactgggtatatatctaaaggaaatgaaataagtatattgaagagatatctgcacttccatgttcagtgcagcgttattcacaatagccaagatagggaatcaacctaagtgtccatcaacaaatgaatggatagggaaaaaatttgtatatgtacacaacgtaataatattcagccttcaaaaggaaggaaattctctcactggcaacatcatggatgcaccaggaagacattatgttaagtgaaataaaccaagtacagaaagacaaatactgaatgatctcacttatatgtggaacctaaaacagttgaacttacagaaataaagactgtaatgttggttaccaggggctttgggaggggcagggttgggcagatgttggccaaaggatacaaagtttcagttagatgggagcaattaagttgaagagatgtattgtgcaccatggtgactatagttaataacaatgtattgtattcttgaaaattactcagagtagattttaagtgttctcatgacaaaacacaaatgatgagaggtaatgtgaatgttaattagcccaattttgccattacacagtgtatatatatttcaaaacaacatgttatacatgatagatatatacaaatgttatttgtcaattaaaataaataagaaaaaaagaattataccttcaagttgtttcgttaaagaaagaaaaaggagaaattctaggcgaataaatgactaaaatcctctatcttctttcagccctatttcattgtgggggatctttcactccaccattattttctcaatacacagtggtgaatgacccacttgttcatagcagatgggtagcccctcctgtttccaatctgtttttggatttcccccatactgaataggtaccagctctactttgttatgattattgcttttatctttacaactactcttatcctggctgacacataatacatttttgtttcgatgaattactccagccttaaggggtcctgctactactctggcaactccctgttccttcccatctaataaacgttaagtagtattctttgatccctgtagcctcatcttggtaatctctctagctagaacatggagtcaggttaaaaaccagagtcttctcagttcacctcacgggagcagttaatagaaactggaagcactaactcaagcatcaaagaaatgaaataacaagaaaggatgaataacagtttttaatagtgggaggccgctatcttcagtgcataatgaatgtgcatcaatgtcactctaaattgtggtttctaatgaattttaaatgtaatgtgcgattttttagctgttaatcataaaaatgaaataatctaggttagagtcaaataatgtgaagcttgttctgagattccttccatagacgctctccttctgttgacccactatctgcctccaccaacttaagaacaagggtacaaattaggcagctgtgatctgtaactggcttgccagaactatgacatactgtaagagaagaaacgaccctctacctgtcacatttttaacctcttccttactgagtcatatttaatcatatttcaaaacaggaataagtaaatcacactacagatccctgtatatgtttttttttcaatgaatccattaaccagttccattgtagagagattacatcaattcaaaaatgtaaattccagcttttcaaactcagctcagtaaaattctaaacttcatttctagatatctgtttacatgggaaatttataactttctggcagataacttgaaacacaggaatagctaagtgagaaagtatttgagtgatagtatagagattatcaatatttctgctaattgttcacattttgttttttctcttccacattttcccacaggaaaaatcagaaaagaacactctccatcgtcagaaagcatgacattgttgccatatatggaacaattaaaagttatatctcatctggaagaaatatgacggaaaaattaataaaggaggaccaggtggtagaggatttaatgaaatgaaggaataatgaaagggtgtcttaaactaaggctactccataacttcgcttgtattaatgataagatataggtagccaggatttggtctgggaatcttctatattgatgctattggataagctttagaagtagatgaaattcatgaggtgaactatcattgcaaaccctgaatttttcgtctctatctctgcctaaattctgcacagaatccactgtactgaaaactttagcatgacagaagtgacatattaaaacaaatattgctgtcagagtggtcttcctaaaatgcaagtccgactacattactctcttttatagagtcatcattgctctcctgtataagttcaaatgccctgacacggcttgcatggccatatactatcttgccccctctcttaaaacttccctgtcctgggccatgcgcggtggctcacgcctgtaatcccaacactttgggaggctgaggtgggcagatcacaaggtcaagggatcgagaccatcctggccaacatggtgaaatcccgtctctactaaaaatgcaaaaattacctgggtgtggtgccatgcaactgtagtcccagctactagggaggctgaggcaggagaatcgcttgaacccgggaggcggaggttgcagtgagccaagattgtgccactgcactccagcctggcgacagagcgagactctgcctcaaaaaagaaaacaaaaaacaaacaacaaacaaacaaaaaaaacttccctgtcctttccttgtcttcctcatttttaatttcttcttctaggaaagctgtctctttgtatagtatatgttcaccaatctggacaagcactcatccccttgatctggctaacaccttaatatcattcatatctcatatctacttcctctgcacagctttccctgatcatgtccctccaacctagtgtccctgttatgtgattttatagtaccttacacttaacttttagtactgcacttactctataccatcatagtgtatttatctgtctttcttactaaactacaaatgcattctttgtcattgtttccttagcaccttataccctatctgacacacagaatgtaatgaatatttgttgaatgtttaataaaaaaaaaagaagcagatcctattgcagaaatcatctatgtaatatttattaacagttttgtcagaaatatgacaataagagcattctgcattttgagtaatcacattcatattggtaggaaatatgatcaaagctctttatttttgagccaaacccattgactgaggggcatatatattgactaatagtaagattttaaaatgaaaccaatctggcttcgtcttattttgtgcaagtggaaaacttccacaagaggaaagacagaagggagaaaacagaagtaattggaagctagtgaaagattggtggttgcagtgggggaatgtatggtgcttaacatttgtcattactcagaaattcataattttgcaatgcaagtctcatccccatcctcgtttctacagttttgtgtgtttatgtgagatgatgccacaatccggcaagaccaaatcttctctccttgacttagtgctgttttattctggctatttggaaatatgttcttgttgctgaattgatcacaatatgagtcctggaatgctgatttttttagcatgcgttctttcaaactggccatttctttggcagtctatttcaacgcatgcaataagaatgaattgtgttatccaaacagagggaaataaaatcacagctgggtgttacctcagctgcaggcatctaatcaagagcactcccatatcatctggctgattgttccctaaattgcctgaatgctgagaaacttctgtcactagacatcactagaattggaattagaggacctctgtgacctcagagatatttagaaagtagtgtctgcagggccataggaagccctttccctggacttaaacttgctcagagtttgactcggtgacatgtttatctttaatctcttccattaggaaatagtgacattttctcctatgctactgcgaaagcacaggttcattgtattttgattggctcccaatgaaacagacatatatgtaaacattgtagtatgcaggtgggttatgccgtctaatcagaaagtagtttagtaataaaccatcttggacctcacttaggacttcagcgtgccaagtgcagtcaaaacatgagcgaaaatctgagagtaagcaggacagaaaaaaaggcagtcacatctctgcagggtggcaaatccactcagataacttattttctatgttcataatgtcacccaccctcactgtggcatatcttgctctataacttgttcttttgttcagaatttgtgacactattgcccttctcctgtaaggggatgtatttcccattagtcagactcccattactcgtaagactggacttatggagggaaaaatgtcttgattttaacacttccactttattctgtgcaactaccttgccacatttcattcatctgattaaagtaaaattgagatatttgggcaaaagagaatctccctgtgcctctttctaaattataaaagttttcgtttttgtttccaagtcattttctgtggaaatctctgtccacagagaactgtggattgtggggatttagaagaaggtgagggtttccaaagaaacagagactgagggctagttctctttgcctttatttacccaaatagtttctagacttcaaacctactctacagcctcacttattccctggggcttataataagaagaaagacatgaagaagcattacttctttcctatccatttggacttatctgaaagagaccatgcaccctgtattatttaaaattcggtatgttctctctgatttctaatccccaaggccctcacctcaagggggaagacaactacatcccaaccctttgctctactcccatgcgtacagtgtttccaatccctcacaggatccagtctagacttcccaagctctttgaattatccagaccctaacaactttcacttgctcaactctcctctcttcagtcttatgtcctgtaaaatattcaatgtttaatttgccatcattaatgttccccacacatttttcatgaaattaactcatctgtaaccattattttcagccatttgcatatcattccctactggaaactttttctttagccaaaactgcttcaaactgcaaggtgcatttcaagatcgactttttattttattgcatagtttaatgactatatgactattctagttcccatgaagcattctttctgtgaattctatactgttcagcactttgttattgaatcatctaatcttttattattgcctaaacatttcacacacacacatacacatgcacacttaatcttatctcctaaatataatgttttccacttattcattatttcagtaaatatcaaatattttccttccatgggtcaaatgctgtgctaagaactgttgatcacataaaatgtaaaatatgttgttcctgctttcaaggagatcacaaactatcagtaaagattaggcacatggaaaaatagcaggaggaagaaagtgctgtatcatgatgagtacgtggaaaaacatttatatgtgagtcttagaaactcaaagcaattaacaatgaatacgttcctaaaacaaataaaaggaaaatgcaaagaattgaagacctcagtcaactggatgaatattcacagcgttttccgatggatcactcaaccctgatctgttggtgtcttactttgcctaaacccaaacagaagacagaatgcaaaggggcacaattgatagagtccacttaagtccttcttccagggcacaaatacggtggcatgattagtaaatgtttttctaaaggagtttgcaatctcaatgcctatgaggaaagtttaatgctgattacaggggaggtgagagattctttggaaaatgggctagaaaaccagataagtagatttgagatttatttggatatggataatcctgagggagtagaaaaccaaatttcaacttgaatagcagtaactttggagatatgtattactcaaatgtagtccattctgtcttaggtgctacagcagttctggaaaacaacttggaaggctgttggtaagcactgtctcaaacactaaaatcaagccaaagcccagagagcaagaaagaaggcgataaatgttgcttaaaaaattatatttcttgtaggaaaataagttagtgaaagcgatgattatcatataatagtgacggatactctattttcctttatgtatcctgcaaggcataccccaattgagcagcttgctatttccccagcaggccacatatttccatcctgaaattaggagggaggggcagagactcccttatttatcttgtgccactgtgttgaatactcttcatttgccccaccagatcttttatttcttgaccatgtgagtggaaagggagatgtcaatcttactgcacaccacaggagcccattgggaggcctccaaactcctgatagtgaaacgaatgcaggagcaggactgggaggctctacagtgacacaaacatttggcaggaaagttgggactgctttcatggtgtatagtctcctttctttagagaccagattctttgagttctcaagtaactcaaagaaattataatcccgactaggtcaattctttggagaaataatgatagtcttaagagctagcattcattggacgtttttcctatatttgtattgaattatattgtttaatcctcaatatagctcataaagtactattattaacttcctcctttccaaaaaatagagtttaagtactttctccatcaaagtacctgtgctattaatacagaaaatctcaagactactagagtatttcaaattccgatcgctgctgtcactaattgaacatcacctgttaccagaccatgatgtgaaaggctttacatagataatcttgaaaaaactgacacaaaaaatggttaaatgtatgggagtatgtgttaaaaattccgataaatctatatatgtacactggaattgaacaattaaatgaatggatggtggatagtgagaatcaggtttctcactattggagtcggagtttataaacaaacaaagggaagaggctagaatgatccatgtggtaagggattatagtttgtgatgtcagtataaatttacatttagcttattatagatacagatggctacatatgcacatatatatacacacacgtgtatacacacacatacatacatatatacacacacacacatatttatatgtatacacacacaaaaaaaattatttggaattcttctggatgggagatttgtcttttctccccaaattatttatgtatttggttaattatttatattagtatggaccctgggatatttattttatgctttggtttatgatccaattgcccacgttgttcctcctttggccattgtgagctctttcagttagcgcctgtgtccctctgacatgcccccattattgtggttgtgtatatgtgtgtgtgtgtgtgtgcgtgcgtgtgcatgcttgagttcttccttgcttactagcaccatgagatgctccagactcatcccatatattctccacttcaatcctaatgccaaccatttctctaaggagactttgttccttttattgaagtatggtattagaaatcaggatctaggatctaggtgtgctcattgctactggggtatagttacttctatgctctctcaactgatagtgcacaggaaatatatatgtgtataataatcattatatatacacatatccatatttctatatgtagccatctgtatctataagaagctaaatgtaaatttatactgacatctggaactatagctcctccctttgcttatttataaactcccactccaatagtgagaaacccgattcccactatccatcatccattcacttaattgttcaattccagtgtacatatatagctgtatcagaattttaacacatacacacatactcccacacatttaaccctttttcatatcagttatttatatatgtgtttgtatatacgtgtgtatatatatatacatatatacttgtatatacagatatatacgtatacacttgtatatacagatatatatacatatatacttgtatatacaggtatatacagatatatatatacatatatacttgtatatacagatatatatacatatatacttgtatatacagatatatacatatatacttgtatatacagatatatatatacatatatacacataaatatgtgtgcatatatatatacacacacatatatgttacacacaaaaaaattatttggaatccttctgcatgggagatttgtcttttctccctaaattatttatatattgtacacacacatatatatatgtgtgtgtatatatatgtgtgtataatgtgcgtgtgtgtctatatatatatatatatagacacacacacacatatacatatatacatatatatattctggcctcagggaagtgaaatataactcccattccttaagtgtggtgtgtgcatagtcacttcattgcaaagaagactgcgatgaaaagataagaaaaagagtaactatctggtagagaaacctgttaaaaactacctcagccaggtgatttaaggtcaacatcaacagtgataagtcatggtgactgtatttgctttctatatgatgtgataagaatggcactttacctctgtggtcttccaaaatgcactacttaaaaactaaagaataggttacttacttaaaatcacataattagtaaaaaagccatattagcacatggtcttctgtatctttacctgtgattgttttcataacttaaaataactgtttcaatattatatttttcagaaactcattgtattgtatttttaagaaactacattggtgaatgcctacatttaatgcctttaatacattagtatctgtcagataatctactatggaattctatgaatctcctagggttgcacattattatttgatttgtcaacataatattttatcttttgacttagagctgttacacatgaggtcatctgtaagtttattctacttctctctctttttatcccatttttgttaattgtactatatctaatttcagaacatatatttaaatattattctgacatgatttttcatactgttgtcttaattttatatatatatatatataatttatacttaccaacagactttgccaaagttttcctaatcatctccagttagctgaagtttatcctgtaggtttttcctcagaaaaggcacatggaaatgatatcatcttagttcttaaaatcttaaaattctttgtctattctctttggacttgaaggacggcttgcctggatgcaaaagcattggcacaaattttcccttagaaatacctttaatgtcttctgtcatttaatgatgttgttgaaaaaagatgatgccaacccaattcttgttacctttgcattttacttaagtggtcaaaaaattctttcttcatttttaaagttcaatagttttcccaagatatgtcttaacatttactgttctggatcatttccatcaggtgcgtactgttgcctttcaagtgtatatttaaatcttcttttactttaagagcattttcttaaattatagtcttgaacatttattttgttgcattgtcttgatctgctttgagctctcaaattagtcacatattaaacctttttctgcctaatttctacagttttgtaggaattctgtgcatagggtgaggatagggagtttatctcgggaatcaagaatatctcaaacttgaaaaaatatatagaagagggggcagagcaagatggccagacagaaggattcacagatgatcccccctcccaggaacaccagatttaacaactatctacacaaaaaaaacactttcataagaaccaaaaatcaggtgagctctcatagtacctgcattcaagttcatattgctaaaagaggcactgaagagggcaggaaacacagtcttaaattgccaatgccaccgctccctcatccaccagcagtggatgtgtagcatggaaaaagaatctgtgtgactggaaaagggaggggaagagcatgcaattgtgagactttgcaatgaactcagtacttccctgtcagagcacaaagcaaaaccatgttgaactcagctgatacctgcccacagagggagcatttagaccagccttagccagagaggaattgcccatcccagctgtcagaacatgagttctggcaagcctcgctaccgtaggctaaagctctcaagccctaagtaaacttgaaaggcagtctaggccacaagaactgcaattcctacacaagtcctagtactgagctgtgctttggtaccagtgctgaatacccagccatacccaggtagtacaccatgggccttaggtgagaccctgagacaagctggcttcaagtgagaaccagtgcattcccagctgtggtggctatggtgagagactccttattcttcagaaaagaagagggaacagtaaagggatttgttttgcacattaagcactagctcagcgacagtggggtagagcaccaagctgattcttggggccctcaatttcaggccttggattttggacagcaattctggacctgtcctgggccggaagggatatcactacctgaaaggtgagtcccaggtctggccgcactcaccataagctgactgcatagcccttgatcttgggtgaacatcactggtccatggcagtaccctatgtgggtctgtggtggtggtagccacagggtgaggcccctctgcttctgcaaagttgagaaaaaagtgggaaggactttgtcttgtggtttgggtggcagctcagctgcagtaaatagaacaccaagtagatttgaaagatttttgcctccaggccctggctcttagatggcatttctggaccaatctggggcctaggggaatgtaccaccttggagaatgacacaagcctggctggttttaccacctcctgattgtagagccgtaggagcatcagcaaacatagacggtagacaggtagtggctacagcataccttgggtaagaaccagtgctgaacttgcttcaggtctgacccagtatagtcacagtggtggtgtccacaggagtgcttgtgtcacccaaccccacgttccaggcagctcagcagaaagagagactctaagagaaagtaagggaagagaacaacaatctccgcctggtaatccagaaaattcttccaggtcttatccaacatcaccaacatggtacctccacatgtctgcacaatcatggaattacttatattacattcctgatgatgcagatacaacttgtatcacaacactcaagttcttttaaatacctggaaaaccttctcaaggaggatgagtacaaacaagcccaggctgtgaagactgcaataaataccaaattcttcaatgcccagacacagacaaacataccaagtatcaagaccatccaggaaagcatgacctcaccaaatgaaccggatgaagcaccagggaccattcctggagaaacagagataggtgaattttcagacacagaattcataatagctgttttggggaaactcacacaaattcaagataacacagagaaggaattcagaattctaacagacaaatttaataaagaggttgagatgatttaaaagaatcaagtagaaattctggagctgaaaaatacaattggcatactgaaacatccatcagagtcttttaatagtagaattgatcaagaagaattagtgcaagtaaaggcaagctattttaaaccatacactctaaggaggtttttaaaaagaaataaaaaacaatgaagcactcccacaggttcaagaaaataaacacaaaagggcaaatctaagagttattgggcttaaaaaggaggtagaaaaaaagataggggtagaaagtttactcaaaagaataacagagaacttcccaaacctagagaaagatatcaatatccaagtacgaggaagttatagaacaccaagcagatttaacccaaagaagactaactgaagacatttaataatcagtctcccaaagattaaggataaaccatcctaaaagcaggaagagaaacgaaactaataacatacaatggagcaccaatacatctggcagcagacttttcagtgaaaatgttacaggccaagagatagtgacatgacatatttaaagtgctgaaggaaaaaatcttttactctagaatagtatatccagtgaaaatatccttcaaatatgaaggaaaagtactttcccagaaaaacaaaagctgagggatttcatcaacaccagacttgttctacaagaaatgctaaagggagtacttaagtcagaaagaaaaggatattaataagcaataagcaatcacctgaacgtacaactctcactggtaatagtaagtacacagaatattataactctgtaactgtggtgtgtaaactactcatatcctaagtagaaagactaactgatgaaccaataagaagtaataacaaaagcaacttttcaagacttagaaagtacaataagatataaataaaatgaaaaagaagttacaaagcagggggacaaatcaagtttttattcgttttctttttgcttgtttgtttttgcagacagtgttaactagttatcaatttaaaataatggattataagatagtatttgcaagcctcatcataatctctaacaggaaaacatacaatggatacacgaaaaataaaaaaacaagaaattaaattatatcacaagagaaaatcacctaaaggaagacaggaaggagagaaagaagaaagaaaagaccacgaaacaaccagaaaacaaataacaaaatgacaagagtaagtctttatccacaataacattcaatgtaaatatactaagctctccaatcgaaagaattaaaaaacatgacccacctgttgtgacaaagaaacacacttcacctataaagatacatgtagactgaaaaataaggggatggaaaaagatattccatgccagtggaaacaaaaaaagagcaggagttgttatatcagacaaaatagatttcaagactgaaactataagaagagataaagaaggtcactctaaaatgataaaggggtcaattcagcaagaagatataacaattttaaataaatatgcacccaacaccagagcacctacatatataaaccaatattattagagctaaagagagagaaaggctccaatgcaatcacagctggagacttcaacactccactttcagcactggacaaatcttccaaacagaaaaccaacaaagaagcattggagttaatctgcactaaagaccaaatggatctaatagatatttacaaaacatttcatccaacaactgcagaatacgcattcttttccttaggacatagattattctcacggatagaccatacgttaggtcacaaaacaagtcttaaaacattcaaaaaaactgaaataatatcaagcaccttctatgactacaatggaataaaactagaaatgaataaaaagaggaattcgggaaactatataaaaatgtggaaattaaacaatatgctcctgagtgataagtagaccaatgaagagagtaagaaggaaattgaaatatgtcttgaaacaaatgataatggaaacacagcataccaaagcctatgggatacagcaaaagcagtactaagagggacgtttatagctataagggcctacatcaaaaaataagaaaaacatcaaataaaacatcgaatgatgcatcttcaagaactagaaaagcaatggtaaaccaaactcaaaattacgggaagaaaagaaataataaaaatcagagcagaaataaatggcatcaaaatgaagaaaacaatacaaaagatcaataaaacaaaagtttgtattttaaaagttaaataaaattgacaaatatttagccagactaagaaaaaagaagacacaaataaaatcggaaatgaaaaaggatacattacaattgatactgcagaaattcaaaggatcattaaaggctatgagcaactacatgccaataaattgaaaaacctaggagaaatggacaaattctagacacatacaacctaccaagattgaatcaagaagaagtccaaaacctgaacagagtaataacaagcaacaatattgaagttgcaataaaaagtcatctggtaaagaaaaccccaggccccagtgatttcactgctgaattctacccaacatttaaagtactaaccccaaccctattcaaactattctgaaaaatagtggagaagggaatactttcagactcattctacaaggccagtattaccccgatagcaaaaccagacagataaatcaaataaagaaaactacaagccaatatctcagatgaatattgatgcaaaaatccttaacaaactattaacaaaccaaattcaacaatacattagaaagattattcatcatgaatgatccaagtgggatttatccctgggatgcaaggatggttgaatatatgcaaatcaatcaatgtgatacatcatatcaaaaggatgaagtataaaaaccatatgattattttaattgatgctgaatacgcatttggcaaaattcaacatccttttatgattaaaaataataccctcaaaaaactgggtatagaaggaaaataccttgatatcataaaggccatatatgagagacccatagctagtaacatactaaatggagaaaaactgaaagcctttcctctaagatctggaacccaacaaggatggccgctgtcaccactgtttttcaacatagcactgaaagttctagcgagagcaatcaagagaaagaaataaagggcatccaatttggaaatgcagaagtcaaattatccttgtttgcatatgatatgatcttatatatggaaaaatctaaagactctactgaaaaactattagaactgataaacaaattcagaaaagttgcaggatacaaaatctatatgcaaaaatcagtaataattctacatgccaatagggactaatctgaaaaagaaatcaagaaaataatcccattaacaatacctacaaataaaatgaaatacctaggaattaacatgaccaaagacagtaaagatctatacaaggaaagctataaaacattgacgcaaaaaaatttaagagcacacaaaacaatggaaaaatggaccatgtttatggagtgtaagaatcactattgttaaaatgtccataattcacaaggcaatctgcagattcaataaaatccatatcaaaatgccaatgacattcttcaaaagcggttgaaaaaacaatcctaaaatttatatggaactacaaaagatccaaagctatcctaaccaaaaagaacaaaacaggaggaatcacattacctaacttgagctaatattacagagccatagtaaccaaaacagcatagaactggcataaaaacactagaccagtggatcagaattgagaactccaaaatgaatccatgcatctatagtaaactcattttttacaaagacaccaagaacatatattggggaaaggccatctcttctataactggtgctgggaaaactggatattcatatgcagaaggatgaaactggacccctatctctcaccatatacaaaaatcaaataaaaatggattaaagacttaaatctaaaacctcacactatgaaacgactaaaagtaaacattgggaaaactctccaggacattagattggacaaaggtttcttgagtaataccccacaagcacaagctaccaaagcaaaagtggacaaatgggatcatgtccagttaaaaaacttctgcatagcaaagggaacaataaacaaagtgaagagacaacccacaaaatgggagaaaatatttgcaaactatccatctgacaagggattaataaccagaataaaagaagattaaacaactctataggaaaaaaatctcataatcagatttttttaatgggcaatgtgtctgaatagacaatcctccaaagaagacatacaaatggcaatcaggtacataaaaaggggctcaacaccattgatcatcagataaatgcaagtcaaaactacagtaagatatcatctcaccccatttaaaatggctgttatccaaaaacaggcaataataaaaactggaaaggatgtggagaaaagggaaccctcatacacctttggagggatttgtaaattaatacagccactatggagaacagtatggaagttcctcaaaaaaactaaaagtagagttacgatatgaaccagcaatcccactgctgggtatatatccaaaagaaaggaagtcagtatatcgaagagttatctgcactctcatgtttgttgcaccactattcacaatagctaagatttggaagcaatgtaagggtccatcaacagatgaatacatttttaaaatatggtatatatacacaatggagtactaatcagccataaagaagcattagatcttgtcatttgcaacaacataaatggaactggaggatattatgttaagtgaaatatgccaggcacagaaagacaaatattacatgttccaactcatttgtgggagctaaaaaataaaacaattgaactcttggacatagagaaaagaaggattgttactagaggctgggaagggctgtagggggatggggaggatgtggggatggttaatgggtacaaaaaaatagttagaaaaactgattaagacctagtatttgccagcacaacagattgactatagtcaaaaaataatttaattatacattttaaaataactaaaagcatataattggattgcttgcaacacaaagaataaatgcttgaggggattgataccccattcttcataatgtgcttatttcacattgcaggcctgtatgaaaacattgcacgtatgccataaatgtatacacctactatgtacccacaaaaaatttaaaaatttaaaaataataaataaaatgggagattgacattatgaaaaaatataaaagacatagaaacatagaatccacataaatggcttaaaaatgaaaatattaacatctctacagaagcagagaccattttttacaaaatttaacacaactttataataaaaactttgtaaattaggaatatatagaatttccctaacctaaagaaaacttctatataattcctacaataaatatctttcaggagtattccttttatttgttagtatagaaattgtttaatgatttttaagagaaatattataaattttggaaaacagtataatgagcttcagttgttacagctattcacccagctgcttcgttaacaccctgatacagtttggctgtgtcctcacccagaatttcatcttgaattgtaatccccacatgtcaaggacagaaccaggtggaagtaatccgatcatgggggcagtttcccccatgctgttctcatgataatgagtgagtcacctgagatctgatggttttataagcgtctgacatttcccctgcttgcactcactctgtcctgccaccctctgaagaagaaagtgcctgtttatcctttgccttctgccatgattgtaagtttcctgaggccacccaaaccatgtggaactgtgagtcaattaaaattctttcctctataaattaccaagtgtcaggtatttcttcatagcagtgtgagaatgaacggactaatacacacccaatccccttgcaccctttgaattacattgaagtagatccttgtcatcatatttttcatctgcagatatttctgaatgtatcgctcaacaaaaagatacatttcaagaatctttgaaaacaaagaatatcattatcaataataaacagtaagtataatattttaatatcattcaatatctagtcaatgtttaaacttcctcagttatttataaatgttttgttaaagtttgtttgaattatatttccaaaaatgcccgtacatagcaagtttatatttttgactttctgtttatcaaagaatgccactattattttctgctatttatttttgtggaaacaaaacaaaacaaaacactgaattggttgttttgtagtatttcactcaatctggatttgactaattgaatccctcttatttagttgaacatgctccgcactctcttgtgttttatgtaaattgttgattatatatatatcctgatttgcattttagcaaaacagcttcataaatggtattgcacccttttgctagaagacccaaaatacctggtgcactctctgttatgatgacaaccactgataggcattgttttttccaattatagttacaaaaagatggtattctagttttattattatttcttcacttactagctagaatgcttctataaagaaacaccttaagataacatttgtgctggaaaggtaagaaaaacactattttattttcaaataaatgaatgaatttgttttttttcatccccccaagttgaccaatgaatgtgatggggtgtgtgtttgtgtctgtgtgtgtgtgtgtgtgtgtgtgtgtgtgtgtacgggtgtatatgttatgaagtacttatgagtgtaaacatattttaaaacatatttatgctttccatttgttacatttattgttattcattctcgaaatatcccatttgagggaagatgcaattcttctctagttgatttgataagattcaaatattatttaataacttttttgtttaccagtgtgaccagatgttctaggcttatctacatttttatccccgtatgtataatcttcaatttccacaacgagaactaattttatttttgaatctctttttttacccatgtttctgtagatattgctttttatttatttcccctgtatcccttagtgtgctttctattttcaggccatcacttcctgttttctggtcatcttttcttgagttcttagatgtatgctttgtagtattcctgcataactatcattgctctttcaaggatttgattttgtaagttttctgtttgttgttttaattcttattataatattaagttataattttcatctgctttgtggaagccatttccagataggttttattccctttgcgtagaaatatatgttgctgttgttcattgtttatcttatagtattcttgtgtgtaggcaaagcttcctcatttcttgttacctgtatttaaatgggatggatttttctagacttctaataggaggatgggatggaagatacagggtatgctagggtagtattccaagcgtcacagcttccagctccctcctctgtccctacagtgaatatcttaaggtattgtcctttctgtagccaattttgctctggctcttagagcacagcctggttcaggtgaacttcctttgccatcctggatctctgagttcccatcgcagcccttgcttacaccacaatgcattcttagaaactgtttttactggaacattttgctacctgccacctgtgggcccctgagcactttctgagccttagttctctattccttctccggtgatcttgaggtgttcaatctcagttatgctcacactggttccctctcagtgagatgttctcatttgggaggcaactattggctggagatgtatggacatgccagcccttagaactcctctgcccaccttgttcttccccatagtcccctcacaatgtcatgcttcccatgtagcttcacctttgatggaatgtatatacaactgggaatctgttgattttttgagtctcctagttttaatgaaaatataatttgaagttgtgacttgtaaaatttctccttgttttctccgtatgaattgtaggagaaagaagatatttcaaaattagttgcttgattataaaactgttggctataagctgcttgcttataaagtttaatttcaaaaacttttataaatagaagagtatgtatcatctgctaagggttgtcaaggaccagtctcagtgcatgtactgtgaatataatgactcagtacagcaaacctgagggctaattactgcccccaggaagcatgctggttgggtattcaagtctgcactgtaagcaggtgcagccaggctggggctccaggaaaggctcagacagggggatttcagatagactggccccattccacagccaagagcatgctgctctgtccaggtctgacagtcaccaaaggccaatgccacctagaggagcatggcaagccttaggggacgggcacctgtggctgtggtccactgcagccattcctgcaccaagccctctggactccacaaagcctggagtcttgcccatgccaccactctaaacagttctccctgccagctaacatgtccatgggggatcatgtgatctcctgcagctaggattctggaggcagtgaagcttcagcagcagctgcctcaggaaacagggaggaggtcatggcccctcctcctggcaggtctgtgtgccacaggcaccatatcaggcaggtgtaccatgggaggctggcatgtaccccgccacttctacccctggcaggtcacgtagaccagactttggggctctccacacctccccagagtgtccctcagccccttaggtgttctgcagcactgccagccctaaatacctctctagtgcctgccttggttttttttttttccccctgtgtatgcatcacactttaccgtttctttgcatgtgtcgtattttttttgttgagaatttgacattttagatattttattattgcaactttgggtactgacccactccagaagtggctgtgatctttgctggtttttcacttgctagtttgtttaatgtcttgggtgaactattcctgtaagtctatttcccactcagcgtgtagcctctgagttatttttctctctatttttgtctttcaacctgactatctggggggtcacccctgtgtaattataaggcacttacttcacaaagattacacttaagccccatttcactagatacatgtttactctctaccatgagatgtttgtgtggcttgaaggttactatcttagttcaaggagtttacggttttatgccccattcatcctggcactagtagtttggtggttccctctagtggtaactctgtatagagtgcagccttgggcatatactcagtcttccatacaatcatggatgaccgtgatattatttttaagcccgtatttttaggagtcacccctgaattagagtagctgattgttcagtcagtgtcttttcaaaggttttatttaagcaccttgtgccaaaaagacttcttccctgcataaatgggtctgtttatggctctgccccatgtctttctctgattgcttctgagtgggtgtagcatagtgtatatccacaggcttcacaaacagggttgactgtgatcctaggaagactctacattggctatctctttccctggtaatcactattaaattcctggctgttctgttgttttgcttatatcagaaataccacctatagttcaccaaggtcttcactgttttcaacaacacacttaggcatgacttctccactcactgttccaaataatgtccactccctcatgcacaactgaggagctatttactcttaaagcttgactttactcctggacagaacccttgtgtctctgcactgaagctgctggtgggaacccacttttccagagtaacacccctattctaagaatgggcattgcggactggaatatcagccccagtcttgtcagcttgcccctccagacatggaacctccactctaccagcaaggtagtagctagacagttggggccagtatcctttgcctgcagtacctaaggtagacctttaaccctatgagtggagatagggtgtgagaagagagaccagttcttctgcacacctagaataaggcttccacacctcagaagtaagaggaatgagacacagcagcagccttcacatcctcggacgaaaatatatccccaggcagctgggtgaaagggatctaccatattcttttttgcacatgcctggggtagaacttttggaacaaataactgggaatggatggataacggaccaagttgtggctcaaatgcctcacactctcggtgttctgaccaaaacttagtaaattctctttaacaaatgtgtctcctaatgctctgtggttttaggaatatctccagagacttcaaaatatttttttcttttataattttcactggtttaattgctttactagggagggagtctaacatgttccttattccatcatttcagaagctccatcttcagtatttattttgtattttttatgcccatagtttctagcccagtatcttcgtgcttgatgttcagtatctcctcatttgttattgctaaaagaatgaatgaatgaagttcccagaaaaatgtctggcaagctctccagtatggtgttactgtgtcctgcaccgttactcctccccatgacttgactcaaatttgggaagatggtcttagtccttactttctcccacatcaatgggagcactgtttctttctagcagatagaagataggctttatgcatcctcccttctttatgcaacattgtatattcagtgtctggggacatttaaaatggtctaaaaatttatttcaaaaatctacaggcaaatcaggttttagtaatctatcatgccaccccaaaagttttaatgtgggtataaagatttattgtggcactggaccatacatctagtgatttccgatctgtattactttatagtaaaacaaaacaaaatcaaattattttctccataatagccgtaacattttttgaagaatgcaactggtgtctcttagaatcatctttactcttggctttaaaaatatcgaagaatactactggcatccttaagtcattgatctgggtttatgctctcagcctatacctagattgaatacagtgaactggtttctgatcaataccgtcggaatctaccctcttgtgaactggacgttacttcttttatgcagccaaagatggcagcagatgggctgtggtattaagtattgccagatgttttgtggcttatgttctgagagtcatcactgcaatatacacatttctaaataaaaatgcatctataagaggctgagctgcagttctaatagggcacagttcccatatgcccttagagctctctatttttgcccaatatcatggtcaattgtgaaaagtgagtgcctggtatatgttctgggtctgagaaaataccttcgctttctcttgtattgaacagtgattatttcttaccttataacttctaaaattttctctttttatttccccttatccacagaatctcagttgaattctattttatataagctaatatgcttctttttatatctgttattttatattcctctaagggtgtctgaaagggctcttaggacatatgcacttggaaaaaatacttacttattttttagctaacaatttccctagctttatccaaagtgaaaacacgtgggaaacttactgatttcacaggattatacattgcataaatgttgatacaaggaaactgagacagagaggggagcattttagttaactagtgatgatatgggccttgccaaataattgtcagggagtccacatttaaactcactaaataaaataatgaacacatgggaggggtggagtgccagcagctaactgtttatttccactgggcgttcatccgtttgtctctcagaggattcataactaccaacaatttgttatttctcattttgttgacctggaaaatattatttttgataccagcatcaaagagaacaactgtttatgtaatcatagacttttgcttcagaagcatgcatggttttttttaactttattccaggggtgaaaataatatttgtagtgagcaatttgactactaagctattaatcaaatgagaaggattcagaagaactgattttaattctggtctaccaccaacatactgtgaatgagtttcaatggctgaatacctgaatgctttcaaatacagaatggcaatgtcaaagtctggttttcctgcctcccaacttttctgattgcaaatgaaatgtgaatttgttatgatatgtgaatattttcaaaaagaacttcttcatgaggacttaaaatatacaaagcaagcagtaaaaacaataaaaaatatattttcaacagaatataacacaaatataaatactaagttcttcatttaagccaaaatgtggataaaatggctccttttgttattaacaaagtgggcctagaatacatgcaatctccaatttgtaccgtctacacacattgttatttaaggaattttattttgtaccgtgtacaaccacattcgtttaagtgtgtgtgtgtgtatatatttaaatgtaagtatacatataaagatacacacaattaaatataagcatgtatacatacacacttaaatataagtatacatatgtatatatgtgatcatacatatatgtgtatatacatatatatatagagagagagagaggctcatgattctacaggctgtacaagcatggtgctgacatcttctagggaggcctcagggggcttttactcataacagaaggtaaagcaggagcaggcatatcagatggcgacagatggagcaagaggaatgatggagggaagatgccacatgcttttaaacaaccatatatggtgagaactcatgatcttgagaaccaagccataagggatcttctgccatgacccaaacacttcccaccaggccccacctccaacattggagattacaattcaacatgagatttagaggggacaaaattctaactatattaattatatttaatataaaaataatacataaatattatatataattaaaagtgcttttaaacattttcttggaaaaactctcaaaatctaaaactcagtacttcattaatgtagaataattcaatatttatttttgtcagaaataacaagaacatattaggaattggtgtgtgtgcatgtgtgtgtgtgtgtgtgtgtgtgtgtaattaaataattttattcctcacaaataatggtatacttggaattatttgagatgtgtccagtctgggattatttggaaagtaatagctgtttagacacataacactttctgtgatagtaacatttttataagggcataagtatagtctttcctaacataaaactacacaaaattcagcaattttaataagccaacttaaattatacattttatctctcttaactataaacgtggcaatttcaaagtgatgtatgaaaacaaaacactataaatacttgcagaaggtatgctttatctcctaactacattccactccttttgctagaaagcaggatggtagttgtcttagcactgccaaaggaattcagagtgtagacagtgcgtggtttcaataataccataaaataggctggataatttgtttggataataatacatttgaatctttactttttactcagtaccaaagatgagactcatttttttaaggtcaatgaaatatgcaattaaaagttactttcacataccttccgtccatgggtgtcagtgcaaattctctgggttcacttctccatagatctgtatagaatcatacaaaatcattcatgcaaactgacctgaaatagctttgaagtattgaaaattccattttacaagttcttctgatcagtaacaaagtggtacatcttcatcttgataaaagccccaaagtattttcattcattgaagtgcctgattttgtgggttttgagagtaggaaggagtaatggggagagcaggtcattaaaaaaaaaaaaaaaacagagtgcaatcagcaccaggaaggtggcagtatgctgctttaaaagaattaaacaaattgaccctcttctgaatatttcactctgtctttgactaacacttattcattacaatagccattatgcataaatcaacaggcctggagagagtgggacacaaaaataattacattttggtttatttcacttaacataatgtcctccagtttcatccatgctatcacaaataatagtatctccttttttttaaggctgaatagtattccatgtgtatatacaccactttttttaatccattcatccaactaggggcacttatgttggtgccatatcttggctattatgaatagtgctgcaataaatatgggattgcagcacaaaaaatgataactatgtgatataatacatttgttaattagctagatttaactatttcaaaatgtatattatatataatttaaagcatcatggtgtagatgataaatttatacaattttatccatcgatctaaaaaatcaaattttgttagccgggtgtggtggcaggcacctgtagtcccagctactcgggaggctgaggcaggagaatcgcttgaacccgggaggcagaggttgcagtgagccaagattgtgctgccatccacctaaaatgtgtcttgttcctccttgccttccaccatgattgtgatgcctccccagccatgtggaactgtaagtccattaaacctctttcttttgtaaattgcccagcctcaggtatgtctttatcagcagtgtgaaaacggattcatacagtaaatgggtaccagtagagtggagtgctgctgaaaagatacccaaaaatgtgaaagtgattttggaactgggtaacaggcagaggttggaacagtttaaacagctctgaaaaaaaaaaaaaaaaaaaaacaacaacaacaacagaaaaaatgtgggaaagtttggaacttcctagagacttgttgattggctttgaccaaaatgctgataataatatggacaacgaaatcccagctgaggtggtctcagatggagatgaggaacttgttgggaactggagcaaaggtgactcttgttatgttttgtcaaagagactagtggcattgtgccccaccctagagatttgtggaactttgaaattcagagagatgatttacagtatctggtgaagaaaatttctaagcagcaaggcattcaagaggtgacttgggtgctgttaaaggcattcagttttaaaagggaaacagagcataaaagttcagaaaatctgcagcccgacaatgcaatagaaaagaaaatcccattttctgaggagaaattcaaactggctgcagaaatttgcataagtaatgaagagcctaatgttaatcaccaagacaatggggaaagtgtcaccagggcatgtcagagacctttgcagcagccccttccatcacaggcccagaggtttaggaggaaaaaatgggttcgtgggccgggcccagggtccctctgctgtgtgcagtctagggacttggtgccctgtgtcccagctgctccagctgtgactataaggggtcaacatacagctcaggctattgcttcagagggtggaatccccaggccttggcagcttccatgtggtattgagcctgtgggtgcacagaagtcaagaattgagatttgggaacctccgcctggatttcagaagatgtatggaaatgcctggatgcccaggtaaaagtttgctgcagggacagggccctcatagagaacttctgctagggcagagtggaagggaaatttggggtacaagaccccacacagagtccctactggggtactgcctagtggagctgtgagaagagggccaccaccctccagaccccaaaatgacagatccacaaacagcttgcactgtgcacctggaaaagccacactcaatgccagcccaagaaggcagttgggagggaggctataccctgcaaagccacaggagtcaagctgcccaagaccatgggaatccacctcttgcatcagtgtgacctggatgtgagacatggagtcaaaggagatcattttggaactttaatatttgactgccccagtagattctggacttgcatggggcctgtacccgctttgttcaggctcataggcagaagggacttgctttgtctcagatgagactttggactgtggacttttgagttaaagctgaaatgagttaagattttggaggactgttgggataccgtgattggtttcgaaatgtaaggacatgagatttgggagcggccaggggcagaatgatatggtttggctgtgtctgtccccacccaaatctcatcttaaaatcccacatgtcatgggagggacccaggcaggcctttcccatgctgttctcatgatagtgaataagtcttacgagacctgatgattttataaaaaggaatttccctgcacacactctctctttgcctgccaccatccacctaagatgtgacttgctcctccttgccttgctcctctctgccttctgccatgattgttacgcggctccagccatgtggaactgtaagtccattaaacctttcttttgtaaattgcccagtctcgggtatgtctttatcagcagcatgaaaatggactaatacagtgaccatgtaatttgtcttcccaaatgggacacatttgaaagtaaaagatagtactatgaacaattatacaggggcaataggcataaaccaggactgtcccacaaaaacactacatatgtctttgtttagcagcttctgataaagattactggttacagaggaaatcagtgacattcagatacaaggagaaatgctactagtcttgcaatacttgcatgtaaattagggaaaaaatgagttcttttctcctggtagatgtatacagctcaataccagggtatatgaatttggttactttgtgcagtaagtggtcttcacaatcatatgcaatagccttatatatggatttgttttaatgaaatcaaggcagaaaaagtgtttttgaagaagtttgaatttgaggaaagagggcttgaatttgaatcactgacaaataataacggatacaagaagtgtggctgaaatagctgattgtaaatttccaagtggagtttggcatgaagttcaagtacgatagaattgtattcattatcattaggcaccaatacttttagaaccatacattttcaggctttcggctggttttttctttctcccttatctcagttactcaacttttcttagtataccatgtagggatttcaccttggtataatctagactatctttctgatagaaggctaacacctataaagtattatttggaacaagaatatttaatgtacaaattataaactatattttactaagccactattgccctgttggtttcttggtaaatcactccatattttagaattatagcaagggcatagtctcttagtctaagacatttgaacacaaaatattcttaagctgtgagtactgttttttttccactatttcaaaaaaaatacagataactatcaaaaacttctactgaccaaccagggccctagacatcttaataaacattgagatgtgaattttatttttagactttccatttaaacttaaatccactagataattgtcaactatattttcagctttctgttgtgtagatgcagtttaaatattaatttccataggagaaatacaaataaactaagaaagtgaaatttaaaacaaacaacactccttgtttttatttttaagatagtcttcccaaaatgtcccttgaaaatctctaagaaagagcagagttaatttccttagtggaacaaaatatcctgactaatcaaaataatattttcagatctcttattcaaaggattacggtttagttaaagaataaggagtaaggaagttatgtttgatgcaaaacaagcctggcaccagtagggatgctacttcaggaataatatattgtccttattactctgctgatatatagatatgacaataaatagacattatcttaaggtgataacagcattctaccagatccagaatagataaattgcatcgtgtagtttcttgatttaatatacacatgaatttttaaaagaccaaagcaaaacttatttctatatggaaatgacaaggaatgaagagacaaagataactgcgtgtgctttgttcaaccctgctgtcatgcattgcatcgcattgaaaacatttttattcaattttaaacctgttgattgatgagctatttttagtattctttctcttggaaatgtaccaggtatgtacacacataatgcaatttgtttctcacatacaaaacactttaaattgagtaaaaacaaacagctttctaatttcatgacatgtggaaaagaaattatattatgaatttgcagtaaaaatgaaatgatagaagtgaattccctcatctattcttcttcaacttgaggggatcttaactaagaaagtggtatagaaggtagtatgagccaataataaaaccaactattaaaaaacattacatttttaaatgttctagtaatgtattgatctgcatattaccccagcacttttacataacttgtaaattttgaaagtttgcctttgtggcaagttaatgacaatgagcgctatctctttcaatttaggaaaattcatctatttaaagtgacctgtacttacagctttgttttttttttttttttttttcgtttttgagacggagtcttgttctgttgcccaggctggagtgcagtggtgcgatcttggcttattgcaatctccacctcctgggttaaagtgattctccttcctcagcctcccaagtagctgggactacaggtacacaccaccacactgggctaatttttgtgtttttagtagagacggggtttcactatgttggccaggttggtttcgaactcctgacctcaggtgatccacctgtcttggcctccaaaagtgctgggattacaggcatgagccaccgtgcccggccctaactttgtaatttgaaagctatcgagccagtacaagaaataaaatcctgcctctatgataatagatttagaagcctctaatgcaacattgctagtaatacgattttggaagcaatttcagcccacaaagtcaagcaatgatctgtaggattgattttacttcactgagggtatattaatgtgccattactttggatttcagaaataacaaatgtgtttcactatatacatgaaaacagtgaagtcaaggttgattttgaattactacattatttaatacacatacacctatttttaaaaatattatttaaaattagatatttgggaactattataatgtgtcaggttaattttctgtggtttctaacaggtaaacttctgttgatcaaatgcattattgtaatctattatgatacaaaaatgctctgtgttaggacatatggataagttccagtttctaggctgaccttaaagtgctaattttggtcttctggtaataaggacagagattaatcatgagttttcccgctagacatgaaaaataataatttatttcatatttgggaatgtgaatttcaaaagatgaaaaaacatcctcaatagttaatgccatctagtgctgaacacatagcaatggcaaagaatgggtgaaatgctgtaacaacacagaaaatatacagagtacagagccacctagtggttattttagcatttcaaaatagtcatatctacttggataaatgaattattaagtattaggtgtcccacaattctaaaacattttcagtttttagatggcatcaaatttaatttcattccatgaatcttgactgtctgtaataaaggtcagcaaacaatggcctgtgggcaaaatgtagcttaccacctatttctgcatagtgcataagctaacaatggtttttacatttgtatatagttgaaaaaccccaaagaaaaataatactttgtgacacatgaagattctataaaattgtaattttattgcttatatatatttttgcttatatataattttattgcttatatataactggaacacaaccttgctcatttgtttacatgtctctcgttgctttggactacaatgaaagagaaaagtagttggaactatacgtggcctgtaaagcctaaaatttactatcgggccctttacaaaaaacaaatttgttggcttctactctaaaatatgttgcaatttgaaaaacacgccaagaaagaaagaatgcatgcatatattttatgtagtgtgtgtaatataaaatgtgatatacgaaatggcatcactctggttcaaaacacaaaaataaagttcaggaagctatttcaagaagattgcctgcattacctgcaaaaagaaaacagaaacaaacaaaaaaccaggaacttgccttgaacctttgaactgggccaaactgcaatgaccacaacatcctggaaaacagccggatttcaccaacactgcaaattcctgaacagcaacaaccaatgaactacggatttgtgtactaagccagctgcctccatcaatgatcattctttcaaagcaacttgtgtaatcacctttagcttcccttcaaaaacccttacttccctccctttcttctgaacgcaatttggcttctagccaaatatgtgtcttccaaatagcaattcctaagacaccaataaatgcctagtcttactgcactgcagtgtggtctttcgcctcttggttgacagtaatatatgtgtttgtacatctgtgtaaatctggtttctttactatatctattattcatatcatttattttgttccaattatacattataattatatgtatatatattatatacaattatacattatatgtatattatatgattttttgtacagctttattcttggggattctaggacacaggcttcaagttttggctccattattgttttctttatccttttctccactgatggttcatgcagcttcctgagtgcacaaagcctccaagacattcctgtgatccatagccccacattggactgtccaagtgtgcttcacaccatctgggtgatttctttacaaaggccccacaggggtgaagagttgtaaatcattgcttggcatttccaaagggctcaatagatggacattctattaacactgcatgaggaggagaggccagcctccatcttccctgtccagagattttgatagtatgatgcctctataaaatggaatgaagcccaaaataaatatagagatgccaatgctaaagggtggaaaactccagtaaaattactctaagaaataatcaggcattgtggctgccttttacatgtgaaaagggaaggatgcaaaactgcaagagagagatgaattaatgtatttctgctgctgtggacattaggctgctgtgattgtggcaaaatgattttgaaacattcgtgagatttgcctgatatttatcttctcagacttccctgacaaatataattaatttatagtttggtttgtaaaacattgagacataacaaacattaaaatacatttttaagatgcattggtttgaaaatcatcatttaaatttttattcctccttgcattttacaaccttaattttactaataacgatgctatttgaagataatacaaagaagaaatttttatataaatagaacatagaaacttcatatgaggtctctactctaaccccttttgcccaatagaagaggctcctcgtgaatatttttgtcaatacctgttaagaaacagaaataattggggttgtaattgctccacattctggccaacacttatcttttgtggttgttggtgttttgttttgttttttcatgacagccatcttaagaggtaggaggtaaaatgtcatcgtgattgtgacttgcattttcattattattaatataaaatatgtcacgttatctgaaatctgtagctctgaaatatgagtattgatataaacattattgatgaggaaattgaaataagaatgattaaattatctgtccaacctaaaacagcttgtaggtggtgaagctttgttttgaatcaagatcattgttttaaattaataagtatagtgcttagtaccagttgaggtttaataatacatctattgtattactaattttgtaccacatttataataaaactaaaatgtttattattgttgaaaaatgaagcaattagtgttctgttggagaatggagttacagcggtgctgagccagggacccagcatcacctcaattgtttctggcccagcaagatctttcctattaccttcccaagggaggtgcataaaaggcacagaaaagaagaacaatctttgttattcagtggggttttagctccaaattccaaagtagagcactgcaaagcaacatagatcacccctggaaggctaaataatccttggtctagaggacagaagacatagaacccagaatcaaagcagtctaagtggtcttctagctttcaaggccccacaccaaatttattatttactattttaattagaaaaaaaggctgcacccaattttcatcttaattgctggccattggaccccacttccgtgaacgagaaaaggtgcgtaaatggagaaaaaaaggtaaagccatccagatgaggccaaaccctatgggtgaggaagaagtgagggtgtgaggtagggtgaaaaagatcaagttcatttgacaggactctttaaggacttagaacactaaatccaatcaaggattgacctactaaataaggacccttgcatactggatgcactgtatgtgtgtgtgtgtgtgtgtgtgtgtgtgtgtgtgtgtgtgtgtgtgtgtgtgtgtgtgtgtatgttgatcataactatatattgaagaaagaataatgaaaaaaggagaccttgaatgtttcagaaagactgtagatttactaatggagaagttgcctattcatttgtttaacatttggagttctatttttattaatttaaattctacctctatttcccttataacttccgctcaacaattacttctagttttacttctagttctgccttctggaaatatatatataaagttgatgtgacacatttgctcatgaaactgcagcaattacaagatttatcctttatcacatcagatgcaaaacttgatcactactccctccctacacatacatacacacagaggcagcaaaaagttaacatctgaatgcatatagaatttaaagtataataataaagaaaaaaaagaatgccgaatttatagatatgatcccaaaagcaaggcaacaaaagcaaaaaaaaaaaaaataggattacattaaactaaaaagctcctgcaaagcaaacgaaatagtcaacagagtgaagggacaacctaaagaatgggagaacatctttgcaaagcatacatctgataaagggttaatatccaaaatatataagggactcaaacaactcaataataaacaacccgattttaaaatgggcaaaggatctgaacagacatttctcaaaaaaaaggtatacaaatggccaacagacatgaaaaaatgctcaacatccctaattatcagagaaatgcaaattaaaacaatgaaatattaccttgtatttgttagaatgcttactaacaaaaaggtgaaacataagtgttggaagaatatgaggaaaagaaagccattgtacaatgttggtgggaatggaaattagcacagcaattatggaaaatagtatggaggttcatcaaaaaattaaaaatagaattaccatatgatccagcaatcctactactgcttatatatccaaagaaaatgaaatcagtaagttgaagagatattttcactcccatattcactgcagcattatgcacaatagccaaaatatggaatcaacctaaatatccatcaactgctgaatggatagagaaaatgtggtaaatatgtacaacagaatactagtcagcctttaaaaagaagaaattctgttatttgacacagcatagatgaaactcgatgacattatgttaagtgaaataagccaagacacagaaagacaaatactgcatgagctcacttatatgtggaatctaaacagttaaactcacagacacagagaataaaatggtggtcctagaatcttagtgggaggattggatagatgttggacaaaggatacaaaatttcagttacatgggagtaataagttcaaaagatctattgtacaacatgatgactatagtttataacagcatattgtatttttgtaaattgctaagagattagatcttaagcgttctcaccacaaaaaaatttaagtatgtaagataatggatatgttaattagcttgatttagccattgtacatggtgttaaatatacgtgatttttatttgccaactaaaaaggttttttaaaaaaaataaaaggaacctgacttaaggataccataatcttttaaagtgggctgctgacaaatctgcctaatccttgccctagaaagacacattctttattatcctgaatagtgaacaaataggccctttgttgcctatcccagaaggagacaatatttctgtctttcaagtggttcgccatacaaacatccttgaaaagatagtttaggacaaaagctaattcaaggtgtgcaaaatgcaagggacccatggaaaattatctcccaaatatatatgtgtgtgtgtatatatatataaaatttatactcataaaagttaatttttgcataaattggatccattttttagtgacatgcttttctttatggacatcttaccttgtcagtatacctcattcttctcaacagctacacagtattgcatagggtcaacatgccataatttattataattctgaactacttccctattaatgttcatctaaattttccccgatatcttgctgttaccaaaagatgctgggatagatatgcttttgtaacgatgcttcagtatttctatagcaaagattaataaaaaatgaaatttctttctcaaaacacgtgcattgaaacatttgaaggataggtacaagttgtctatgtcaaattatgtacccccaacagtatgagtttccaagctctattttccagagtgctaacatacttatatgctcccattaaggatgaaccgatgaaaagatatgatttaaaattatcattgggttccccatcgtctcagccgaaaatctccttaagctgataagcaatttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatacaacttacaagggatgtcaaggatctcttcaaggagaactacaaaccactgctcaaggaaataaaagaggacaaaaacaagtggaagaacattccatgctcatgggtagaaagaatcaatattgtgaaaatggccatactgcccaaattaatttataaattcaatgccatccccatcaagctaccaatgactttctaaccggaattggaaaaaactactttaaagttcatatggaaccaaaaaagagcccgcattgccaagtcaatcctcagccaaaagaacaaagccggaggcatcacgctacctgacttcaaactatactacaaggctacagtaaccaaaacagcatagtactggtaccaaaacagagatatagatcaatggaacagaacagagccctcagaaataacgccacatatctacagctatctgatctttgacaaacctgagaaaaacaagcaatggggaaaggattccctatttaataaatgttgctgggaaaactggctagccatatgtagaaagctgaaactggatcccttccttgcaccttatacaaaaattaattcaagatggattaaagacttaaatgttagacctaaaaccataaaaaccctagaagaaaacctaggcaataccattcaggacataggcatgggcgaggacttcatgtctaaaacaccaaaagcaatggcaacaaaagccaaaattgaaaatgggatcaattaaactaaagagcttctgcacagcagaagaaaccaccatcagagtgaacaggcaacctacagaatgggagaaaatttttgcaacctactcatctgacaaagggctaatatccagaatctacaatgaactcaaacaaatatacaagaaaaaaacaaacaaccccatcaaaaagtgggcgaaggatacgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacagatgctggagaggatgtggagaaataggaacacttttacactgttgatgggactgtaaactagttcaacgattgtggaagtcggtgtggcgattcctcagggatctagaactagaaataccatttgacccagccatcccattactgggtatatacccaaaggattataaatcatgctgctataaagacacatgcacacatatgtttattgcggcactattaacaatagcaaagacttggaaccaagccaaatgtccaacaatgatggactggattaagaaaatgtggcacatatacaccatggaatactatgcagccataaaaaatgatgagttcatgtcctttgtagggacatggatgaagctggaaaccatcattcttagcaaactatcgcaaggacaaaaaaccaaacaccacatgttctcactcataggtggaaactgaacaataagaacacatggacacaggaaggggaacatcacacaccaggggctcttgtggggtggggggaggggggagggatagcattaggagatatacctaatgctaaatgatgagttaatgggtgcagcacaccaacatggcacatgtatacatatgtaacaaacctgcacgttgtgcacatgtaccctaaaacttaaagtataataataattttaaaaaataaaataaaataaaataaaaataaaaaataaaataaaattatcattgggtagtactttttgaaaactaaaaaatgtaattttgccctctgtaccaaatttattcctatacaaatgctggaagctggctattattagtttcaattttaaataaataaagggaagcatttcaataaatgagaaaactatggaaaagagagaagtaatcagagcttccagtgttaatttcttatatttttgtattcaatgctgccgccttccctgagacaaataaggtatacgcaatctatgaggccatacatcaaaaggaatgcaagaacttcctactggagcatttctacaatgtattttatcccacataagcaactttgctacatagcttcatcacgttttccaaaactgagtttcatggcagtggacttgagactagggattcttactgagcttgatgtcaactaaaacttgtttggtttttgttgttttgtgtttttgtttgttatttgatgctgctgcttctgttgttatacttttaaaataaactgccacttagctgggtatccccaacctatttgtgtgtgtaggtataatgttgtattttacttctgaatgaataacttaatacgactcctaaatgcatcaccttgccaacttcagctcatatttccagattgtcaagatcttttcacacttgattctgtcttctatcatatttgctgactcttccatttctacatcatccattatttaataaatacagaattcattcaactcacttattaaagtgttgaacaagacgtatccaaacccaagcacatacctatgccagcaatatcttatctgagggtggacatcattctctttacaagcctgtcttgattttcatcagtagagcaatggccatgaattcaatccaatgtcactgggtcaggtgtagggtacacaagatgactgtagtaaaatgaaatgctaatggaagggagaaagctgccacttttcacatatatctgtagttatgtaggcttcatgggaaaggtagtgtaaaaagatagcacatacatagaattaaattctagtaaaataagatgagcttaatttattcattttgagcattgatataatgaataattttacttatatatttatttatttttaggtgcaaacttttttatttttattttttgtgggaacatggcatatatatttttagggtacataaaatattttgatacagacatacaatgcataataatcacatcaggataaatggggcatcacctcaagcatttatcctttcttcgtgttacaaacaatccacttatacacttttagtcattataaaatatacaataaattattggtgactgtggtcactctgttgtgctatcaaatactagatcctattctatttaactatattttataacccattaactatcacctctttccctacaactacccttcctagcctctggtacccatccttctactctctatctccatgagttcaactgttttaatttttagctcccacaaatgagtgagaacatacaaagtttgtttttctatgcctaatttcatttaacataatgtcctccagttccaaccatggtggtggaaatgataagatctcattctttttttatggctgaataataaatacttccttgtgtatatgtaccactcttttctatttatctgttgatgaacccttaagttgcttccaaattttggctatagtaagtactgctgcaataaacgtgggagtgcagatatctcttcaatgtactgatttcctttccgttgggtatatacctagctgggggattgctggatcatatagtagttctaattttagtttttttgaggaacctccaaatggttctctatagtggctgtactaattaacattcccaccaacagtgtacaagggttcccttttctccacatccttgtgagcattcattattgcctgtcttttggataaaatacattttaactggggtgagatgataactcaatgtaattttacattgtatttagctgattatcactgatgttgatatacctgattgccatttgtatctcatcttttgagaacggtctatttagatctttagcctgtttttaaattggattattagtttattttcctatagaattgtttgagttccttatatatcctggttattaatcccttgtcagatggatcttttgcaaatatttcctcccaatctttaggttgtctcttcacttttttcattgtttcctttgctgtgcagaagcttttttaacttgatgaaatcccattggtctatttatgttggttgcctgtacttgtggggtattactcaagaaacctttacccagtccaatatcctggagactttccccaatgcattcttttaagagtttcatggtttgaggtcttagatttaagtcttgcattcatgatttttgtatatggtgagagatagggttctactttcacactttgcatatggatatctagtttttgcagcaccatttatcgaagagactatcgtttcttcaatgtatgttcatggcacctttgttgaaaatgagttcattgtagatgtacagatttgtttttgttactgatttttgtaggttgattttgtgtcctgcaactttactgaatttgtcagttccaaatagaagatcgtatcatctgcaaacaaggataattttacttctacatttccaatttggatgcccttttttttttctcttgtctgattgttatagctagaacttttagtactatgttgaataacagtggtgaaattgggtatccttgtcagtttccagatcttagaggaaaggctttcattttttcatccattgagtttgatactagctgtgggtctgtcatatatggctgttattgtattgaagtatgtttcttcaatacccaacttttttagggtttttatcaaaagcgggggttgaaatcctagtttttgacaaaatagactttaaaccaacaaaaatcaaaaaagacaaagaaggacattgcataatggtaaatggataaattcaacaagaagagtttattattctaaatatatatgcacccaatacaggagtacccagattcataaaacaagttcttagagacctacaaagagacttagactcccacacaataatggcggcagacattaacacctcactgtcaatattagatagatcatcaagacagaaaattaacatggatattcaggaattgaactcagttttacttttttgatgtgtctttgtctggttttgctattagggtaatacttccttctcctttaaatgtttggtaaaaatcagcagaaaggccatcaggtccaggcttttatttgctggaagactttgaattatggcttcgatctcattacttattataggcctctttagcttttggatttctttggggttaaattttggtagattgaatgcctctaagaatttattaatttttttctaagttttccaacttattggcatatagttgctcataatagccactaataatcctttgaatttctgtagtaccaattgtaatgtctccatttttatctctgatttgatttattttggtcttctatcttttcttctaagttacactggccaaaggtttgtcaattttttttcttttaagaaaaccagcttttcattttcttgatcttttgtattgttttctttgtatcaactttattcgttgtgtgattattataacttgttttcttctactaatttaaggttaggttggctttctcatttttaattttttaagatgcatcatttggttgttcatttgatgtttttctagttttttgatataggtgcttatagctataaactttcctcttattaatgctatcactgtatatgataggttttggtattttgtctttccattatcatttaaggaaatgttttaatttctttcttaatttcttcattgatccactggtcatttgggagcatattgtttaatttccatgtgtttgtatagtttctaaaattcttcttgttattgatttctagttttattccattatagtcagataagatactggatataatttcaattttttttaattttgtaagacttgttttgtggtctagcatatggtatatccttgacaatgatccatgtgttgagaatgtgtattctgcaaccactgaatgaaatgttctgtaaatatctattaggtacatttgttcttatagtgtagattaaatctgatgtttatttacagattttctgtctggaagatctgtccaatgctgaaagtggggtgttaaagtctccagctagtcttgtattggggcctatccctctctttagctctaataatatttcctttatatatctggctgctcccctgttgggtacatatatacttaaaatcattatatcctcttgctgaattgactcctttttaatgatgtagtgattttctttgtcttttttatagctttttcttgaaatctattttgactgatatgagtatagctgcccatgatctctttttgtttccattgaatatcattttccatccttttattttcagtctgtgtgtcttcataggtgaagtatgtttcttgtaggcaaaaaaatcattgggtcttgtttttctatcccttcagccactctgtatcttctgattggagagtttggtcatatcattttcttatttgttttctgattattttgtggcattatctttgttttctcttttcttcctgtcttccttttagtgaagagattttctctgctgatatgatttagttccttgctttttattttttgagtgtctgatatgtattttctggtatgaggctaccatgaggcttgcaaatactatctcataacccattattttaagctgatgacaatttaacactgattacataaaaaacaaacaagcatagagaaaactcctaaaaatctgctctttaactttatcctcccactttttaacattttgttgtttctatttgtattgtactatatcttagaaagctactgtagttattacttttgattgattcatcatttattctttctactcaacatatgagtagtttactcaccacaattgcagtaaataatattctgtgttttttgtgtacttgctactaccaatgattttttcaccttcagatgacttcttattgctcattaatgttcttttttatttagattgaagaactctattttgcatttcttgtggtacagctccagtgttgataaaatacctgatcttttgtttacctgagaaagtctttattttcccttcctatttgaaggatatttttgttggatatattattctagggtaaatgtttttcttcctttaacactttatatcataccactctttcctggcctgcaaggtttctactgaaaagtctgctaccagatgtattagagatctattttgtgttcgttctttctcttctcttgctgcttttgggatcctttcttgatccttcacatttgaaagatgtattattaaaagtcttagagtagtcttattttgtttacatattcttgttctctaaccttcttgtacttgaatgctgatatctttccctaggtttggtatgttctccgttattatccctttgaataaactttatacccttatgtctctttctactttttctttaaagccaatatctcttagatttccccttttgaggctattttctagatgatgtaggcatacttcatttatttttattattttgtcttttgtcttctctgactgtgtattttcaaatagtctgtcttgaagctcactaattctttcttccagttggtctattctgctggtaagagactctgatgcgttcttcaatatgccaattgcatttttcaattccagaatttctccttgcttctttctaattattcaatttctctgttaaatttatctgataagattctgaataccttcttatgttaatcttgaattttgttgagtttcctcaaatggctattttgaattctttgaaaggtcatatatctctgtctcttcagaattggtcccaggtgccttattaatgcattatataagggtatattttcctggatggtcttgatgcttgtagatattcatcagtgtctgggcattgaaaactttggtatttattgtagtcttcgcagtctggacttctgtgtagctgtccttctggggaaagctttctaggtatttgaagggacttgggtgttgcaatctaggtttctgatcactgcagccatatctgcattagagggcaccccaatccagtaatgcaatggctcttgcagagttatagaggtactgccttggtggtcttggataagatcctgaagaattctctagattatcatgcagagattcttgttctctccccttacttgtttccaaacagagtttctctctttctctgtgctgagctgcttggagctgggggagtggtgacaaaagtatccctattgccaccaccgctgggactgtgctgggtcagacctgaagccaacacaaaactgggtcttatacaagacccacactaaccactgcctggctactgcctatgtttgctccagtccttaaggctctacaatcagcaggtggcaatgcctgacaggcttatttccttcttttcagggtggcaagtttccaccagccctgggtgggttcagggataccatccaggagacagcttctggagtgggaaacattaggaatctacctggtgctccattctactgtgactgggttggcacccaagccacaaaacaaagtccttccccctcttcctccccatttgcacaaacataagagtctctcccccatggtcaccactgctccaggcccatggcaagtactgccaggctactgttgatgttcactcaagtcctcagggatcttcatccagcttgttgtgaatgctgccaggcctcagactctctattcggggaagtgggctccccactggccaaagacaggtccagaaatgccaggacaggtccagaagaggcaaggtccagaatcagggaccccaacagaccacttggtgctctaccctcctgtggctgagcttatacctaagctgcaagacaaagtcttctttagtcattcctctgcttttctcaagcaggagtctcttcatatagcaaccacagctgggaatgtgctgggtcacacctgaaaccagtacatttctgaatctcacctgagacccatgacaagtactgcctggctaccactgctgactattcagagcccaagggctctttagttaccaggtgatgaatcgtaccaggactaggtccttttctttaaggcagggggtccccttctggcctaaggtgtgtctagaaatgtcatccaggatatagggcctagaataagggcctcaggtctctgcctggtgccctatcctactgtggctaagctggtatccaagttgcaaaacaaattcctctttactcttccctctcctctactgactgcttaatggacagagggtttccttttggtgtaaggaaaacattcttgaattagatatcgatgatgattgtacagcattgtgaatacactaaacagcactgaattgtagactttaaaatggttacaatggtgagttttatgttatgtaacttttatcctaatttaaaaaatcataattgctgaaattatgaaaagtaattcagcaggcagatggcttctttttttttttttttttttgagacagagtttcactcttgtcacccagggtggagtgcaatggtgtgatcttggctcacagcaacctctgcctcccgggttcaaggtattctcctgcctcagcctcccaagtagctgggattataggcgcccaccaccaagcccagctaatcttttttttttttttttttttaagtagagacagggtttcaccatgttggccaggttggtctcgaactccaggcctcaggtgatccactcacctcagcctcccaaagtgctgggattataggcatgagccaccacacctgaccagatgtcttctttagaaaaaaaaatgaacaataatagctaataaacctgccaagtgaatatgagaaattcactgctttctgcaaattaaaaaaatagtaatgagcatttaaaattattcattaggaggcagagcaagatggctgaatagaagtctgcactgatctgccgggcgcagtggctcatgcctgtaatctcagcactttgggaggctgaggcgggcggatcacgaggtcaggagattgagaccatcctggctaacaaggtgaaaccccgtctctactaaaaatacaaaaaattagctgggcgtggtgccacacgcgtgtagtcccagctacttgggaggccaaggcaagtgaattgcttgaattcaggaggtagaggttgcagtgagccgaactcatgccactgcaccccagcctgggctacagagtgatactccatctaaaaatatataaaaataaataaaaatacctgcactgatcatcctctcctctcagaaacaacattgattatttagaactatattgtctaatttccgtacatttgcaaactttcaaaatttccttctcttattgatttctaatttcatttcagtgtggtctgaaatgtactttgcattatttctatcattttaaaaccatttaggtatgctctattgcctagctatgatctatcctgagaaatgttccatgggaacttgagaagactgtacattttccactatatgttaggactacttgtttacaatgttggctaattactctctttacttattgatcatctaggagttgttctgcacattattgaaagtatacttttgaaatctctattatcagtgaactgtatttaaccatccaattatgtcagtttgcctttgtatattttgcagctctgttgttaggtgagcatataattaactgtcacatattcttgaagtgttgacacttttatcatatatagtgtcctatgtctcttacaaaaacttacttaaattctatttggtctgattttattatagccacttcagccctattttatatttccttggtatacattttacctttctttcatgttcaacctgtttttgtctcttctccccttttacttttagctgacacataacaattggacatatttatgggatacagaatgatattttaatatgtgtctacaatgtataatgatcaaatcaggataattagcatagtcatctccccaaacatgtattatttctatgtgtaatataaacattcaaaattctctcttctagctttttgagaattacaataaattagacttaactatattcaccctacagtgctgcagaagaccagaactcattcatcctgtctagccgtaattttgtatctgttaaccaacctctccttattctccccttgccactacccttttcagcctctaataccacaattatactctgcttccatgaactcaatgattatttagctcccacatatgagtttgaacatgtggttttatgtttctgtgcctaatttgttttgcttaccataatatcctccaagcttatccatgttgccatgaatgccaggattttattcttttttatggctaaataatattctaatttttatatatacaccacattttccttttccttttccatttgtctgttgatgggcatttaggttaatttcataccttagccattaggaatagtgctgcagtaaacatgggaatacaggtatctctatcactatacacaataattaacttaaaatggattaaatacttaaatataagaccaaaaattataaaactactaaaagaaaacaggcaaagcactccaggacactagtataggcacaaattttatgagtaagacttcaaaagcaaaggcaacaaataaaaaatagacaaataagactatatcaaactaaaaagccttctgcacagcaatggaaacaatcaacagagtgaagagacaacctgtagaatggggaaaaatattttaaaactattcatctgacaagggactagtatccaaaatatacaaaaaatggaaacaactcaatagcaaaaaaacacaaataatcccattaaaaagtgggcaatgaatctttgtaaacatttttcaaaagaagacatataaaatgtccaaaaggtatatgaaaaaatgctcaacatcactgatcatcggggaaatgcagatcaaaaccacaatgaagtgtcatctcaccctagttaaaatggcttttaccaaacagacaaaaaataacaaatgctggtgaggacatggagaaaagaatactcttatacactgttggtgggagtgtaaattagtacagccattatggaaaatagtgtggcggtctctcaaaaatctaaaaatagtttctcaaaaaactaaaaaactaccatatgatccagcaatgccattactgggtatttatccaaaggaaaagaaatcactatttgtgtcaatctaatgtgagtcttttccacacagcatagagatgaattgtatttttcaaccattgtgccaatctgccttgtaattagacagtttaatcaatttacattttatgtaattactgctaagataggagttccttctactcttatagtatttcctgtcaatatttttttcttttttgtgcctcaattcctccattactatgttcttttgtatttaattaatttttattgtagtgacttgattgttttctcatttccttgtctttatatattttagttatttttttagtgcttacatggggtattataattgacatctgaaatttataacaatctagtttcaattaataacaactttgcttgtatagtatacaaaaactttcagtggcatatacaatgtctgtccttatatagctctgccccccttttatgttgttattgtcacaaattccatttttatcaattatatccccattagcacagatttatacttattgctatataagagcaaaaaagcatttacaaaccaaaaatacaataacacttgttttaataatttattcatatgactttaagttgctatctaatttccttttatttcagcctaaaaaactcccttcagcattttttatgggttgggtctattaacaattaactgtcatgctctaatttatataagaatgtcttaatttctccttcatttttgaaggacagttttgtcaaatagataattcttggttgacaggtatttttttctttcagtccttaaatacattatcctacttcctactgatgtgtatggtttctgatgaaaaatcagttgttgatcttatggaagttccattatgtgtcatggttttttgtttgtttactgtttccaaattttctctttctctttggcttttgacaatgtatttattttatgtcttattatgaatgtatttgagattatcctattttgaatctgttgagctttttgaatgtgtagatttatgtctttcatcaatattgggtagtttttgggcaatatttcttcaaatattctttatgaccattgatctctttcccctccttctgagattcccataatgtgtgtgttggtatgcttgatggaatcccatatggctccttaggctcgtttcaaatgtcttcatattttattttccttcttttcctcagactggttaatctcaaatgtcctatcttcagacttgctgattctttcttctgcccactcaaatctgctgctgagcttctctacagaattttcatttccattattagatttttcagctccaaaatttctatttttttaaataatttctatcttgttattgatattctgtatttatcaagccattattctcctggtttctgttatttctttgcccatggttttctttagttctctgagcacacttaagatagttgatttaaagtctttgtctagtatgtccaatgtctgagcttccccagagatagtttctattaatttcttattttcctgggaatgaaccatacttttgtttctttgtgtgccttataattttttgctaatactttttaaatattataatgtggtaactatagaaatcagattttacttccttcccatgatttgttgttgcttcttgtcagttgtggttgttgttttgggtagtatttttagtgacttttctaggctatttttgcaaagattgcattatttttcactttattattgaggcctctgttctattaaacttgtggtaagctaataattttatagggatttccttaaacacctgtagccaaaaaaaaatttaatactctcccagtttttgcgtatttgctccattgtggtcaccatttcaatgcttagccaagccatttacaactctgcctttgccttcactttatcttcatggaacctaaatgccagccgaaggtgatagcttagggtttttgcaagtcttttctgaacatgtatccagcccttagtgtgtgtatgacttttacattctccaatataggtggcaccttttcaaagccattattctcccatgtatctccttcagcagtctctccctttccaggcttttcggcctgcctgctgcttgctctatctgttatccctcatctcatgtggacatggactttaaatgcttttgataaatgcctactggaaagccaatccagtgctgagggaactccattgggaaagcaaaacaaaagcaagcccctgagattatctctcagggagccatcagacagtacaaaataccaattctttgttctcaaagttgttctcaaagaattggtattttctccttctctgtcacttgctagccacaccaagaaccacaaatactgcaggactaaagaaagcatagagtttttccttcctcttctacagtattttttttaaaaaacttttatggccgggcatggtggctcacgcctataatcccagcactttgggagggggaggcaggtggatcacgaggtcaggagaacaagaccatcctggctaacatggtgaaaccccgtctttactaaaaatgcaaaaaattagccaggcatggtggtgggcacctgtagtcccagctactagggaggctgaggcaggagaatggcgtgaacccgggaggcagaggttacagtgagctgagattgcgccactgcactccagcctgggtgacagagcaagactccatctcaaaacaaacaaacaaacaaacaaacaaaaaaaaaacttttctaatacatatgtgatcttgttagttgtaaaaatgtctgccttctcttatggactttaattcaatgaagttggactgtagtttaaatgatcactcatttcccaataatttcaacagtacctggaaaataataggtgttcaataaatgtttgttaatcaagttcactctatataaagtagatgaattaagactctgaaagtttgatgtgacttgcagtgactcactcatctactcagcagggaaatctagccgaagcaccagaatttccaggaaaaatattatgtagtttatttacttctctgaattttaatctcgccttgctaccatgacttgccctcgagcacacagaccatgctgaacttccagaaattgtgttagttccttcatgtgtccaacctcaatccctgtgctatgctcacagatagtctcaaaggaggtctttaaaaaaaatatatggactactttcttctaacaattgtattgttaaaaaatcctttatgaaaaaatactttatggtcaatcccaactgctttacagcaaattagccacccatcattttttcttgccccaaatgctcaagattcctacaaagttcaggactagatagagattacaaggtaataatttctgtctattgttttgctagtccacccaaaggaatatctatgcctttaattgcccactttagatagctttcagcttttgaaaattcagtaagaaaaaattcccagtaaatatcaccatttgacaaaatatatcaccttcaggggaagcaaagtacaaatgtgaaccacatgaacctaagaagcaaagtgagccacacagatctgccaaatttgatatactaaagaggaacatcattcttttttaattgtacataacactttgagaacattattattctaaaatgctaatccttattcagtgccctcaggccttgctgtaatcctctgtaggagcaattttcactgacagtggccagtagttcagtcactagtaggcaaaagcattacattgataaacataaatccttcagctagggaaacaataaataactttaacagatatgtaattaataggctgctcaacaagtgctctgagctccccaagctggtatttaaatgcaaatatgcaccagagtgtgaaaagcacgaatggaagagagaaccaccatgaaaccatgcaggcttcccaaaattcaacaaggggcttagtacatggtaatcatgtaactgcccaaggagttcaccttgcctgctgcctagacagagccaattcatcaagacaggggaattgcaatagagaaagactaattcacacagagctggctgtgcaggagaccatagttttattattacttagatcagtctctccaagcattcagggagcagagtttttaaggacaacttggtgggtggtgggaagccagtgagccaggagtgctgactggtcagggatgaaatcataaggaagttgtcttcttgtactgagtcagttcctaggtgagggccacaagatcagatgagccagtttattgatctgggtggtgccagctgatacatcaagtgcaaggtctgcaaaatatttcaagcaccgatcttcctagcagtttagggagggtcagaatcttgtagcctccagctgcatgactcctaaaccataatttctactcttgtgactaacgttagtcctacaaaggcagtttagtcccaggcaagagggaggtctgctttggggaagggctgttatcatctttgttttaaactataaactataaactgagtttctcccatggttagttcagcctatgcccaggaatccacaaagacagcttggaggttagaagcaagatggagtcaattaagttagatctcttttactgtctcagtcataattttgcaaaggcggtttcaatcacaacaatatgtccaggtcaagcactagtacttatcttcccttggaagtctgcttaggtccagccaacaattgcacacacttgtttaaaaaagaaacttctaatacaggggatggggagatagtatagaaacaaaagacaaatattcttatggccagcactctatgttttgttttcaaggatgttagatgtaaaatttaatttttccttctgataattgtttttcagccatggagtttcaagaatatggtgtatctaattcaaaacctttaaaatttatgttataaaatgtattacagtgttctaataaatcagctcttggtagtaacaaattaccagtatgtaccatgtattaaaaagataaatgggaatttaatagttaagagagaaggtgttttcagatcacacagccaaatcactaactaatggacacatttgtaaactcggcaatgatttacaccagggctcttggttagagtgcataaatccagcagaagagtttttatctatcaactgagacttttggtcccttgtttataaatcaaaaagttaacaaagagtcaggggtctgtaaatccagatactatattataaatttgtagctttttatttataaataggtagctttaagaattatatataacaaatagaaaaatgaattgcatttaaaattaagtgaaggttagtatttataaatcacaattataaataaaatgtctatatgtttgcatcaccaaccaataccatctcaaccaattccaaaactatgcatttcataagatcatagcagggatgtgccaagcagaatgtcaacacttggcaacttcagtgcaggaattaactcaatgttattctattaactttaatagggaacttttaaaaaatatagcatctgcattaaaattttttgtttcaccataaaaggaccaaataatggttatatggcaagtcataacttgaaaagactgcatctagttatagacatgaagttcaaatgtcttccttttctcttaagatacactaaatatatttcctaagaagacccaatgtaaggacaattctctcacgttttgctttgcctcataacttctcctcacagtggaatccaagatgagcaggtgtcatttcagggccaggttactcaggtcccatgtggccatttcacacaagccacaggctgtgactctgaaggaggtgagcttaagaccctcacatgacctcctgtttgtgaattttcaaatccctcctgagtggagaggggagactctcatcacaaaagaacacaagagaaacagaatcaaacgaaatgaaaaaggaaagaagtaagaaatccctactggctcagagacaaggttaaatacaacttgtttgccttttactgcctctgcttcagaaggacacccctgctagactgcctccctgtgagctacatcactgtggaagagccgggcccaagtgaggttctggggagtctcattccaccaaggatccgctctgtcccttctcctagcatctcacccaacccttgagggtcaggtcctttattctcctggctactctgaacctgagtgaaatatcctgcttcccattccaaaggaagtgaccctgccttgtgtcctcttctctctagatggtatgagtgcctcactaaacaataaaccacctatgtaccagatctgaatggatgctaatctgtgactccatgtgggttgacatctttacatgttagtaggaaccttcaagtactcttctttactggagataataatgcaggactttatataggcagcaaaatgtggggtaagaagctgtaagggaaggctggagatattttacgtgaaaggtatttgggaatagggacatctgccctggaatcaccagtgcttactgcattgagtagagtggggttaaataacatctcagcagcctactggatcataattgttaaggacctatgtagaaggtacccgcctttttcctcctgttttcactcagtagttattcacgaatgcagccaccctggactctcctgtatgccgcttgcataaggtctaaaaccacagcatcttgaggttgatgcaatttccggtgaggagtgaggaataggagacccgaggcttatcctttgaaccccttctccaccatgatgacctcatgacatgccctttgttttctgtcctttcacagtgacctcgttgtgcggcttcctcaaatgtaggttcatggactgcacatctatattcattttctggctttcggtttggaagctgtgcagctcctccctgcatgacactcccagggaacccacataagaatccaaatgtcaactgcgtcctcatctctgactacagatggaaccactcccaagcatgccatgcaggtcccttggaagggcttgtacataggagccacttaatatgatttgttaaattctaaaaatacaggcttaaagacacagtgcatttcaaagcttgaggaaatgtactgagttatagggttataaagcaaattcatatcagaaattaattaaatgaaataaaagagcacagatcctaaaacacagaatttgtagataatattatttcttcacttgaaatttactctcaagtgtatttaatatcagacctaaagatacatctgatgtggcattgcagactcattttacccttctgcattcttcttagaactttagagacctgggtatgtcaacagcttattgggatagtaacaaaatgaaaaatcagagcaagtggtcccacgagttaggtacagaaaatcatccatcgccctgctgaagcagctccattaggtccaatataagcaaacaaaacttatgagattgtataacatggtattttgcttcataagcatttgattacattttgtctattttttggaataagataggactcattagtctggacacatgcacacacacacatacatacacacaaactccccaataaatacaaatatattgattcttataaagatcaaaatcaggaatatttattgctcatgctttcatttgcaatacttgttgtaaactcccaaccacttaaatgtttcccattataagttcatcaacccttaacacgtgttactcaagttataattttgctaatatcacctatttttaaagaactaccaatgctacattactgatataactttattctctccaaaaaaatatggcactagtttctaaacctgactttataaagttcagctagtcaccaaataaagcgcaatgtttgtcagctattgtagagaaactggctgttatgtgaaatgggctgctccatcagcagattgccagggatcatttccaaatagaggtgggaatataggctgtttaaataaataaacaaacaaacagaagatagagcctgtcacttgcaaaaagaacaaccaaatcatgacttggggcctgtgagggttatgttccatcttctccagttctaccaacagcttttctctgctcttctctgtgccccagaaggctgcatcttgcagtgttcatcaggggctcctctgctctctggctcctgttgggtttggctgatgggaggcaccagcaagagcatggagggcaggaagaaagtgaggttgcggaatttattcctcaaacctctttcagacttgggcaattgtggcagtcactgtgcccctccacaactatagctcttaccagtgacttctctggcaaggctccccctctcaactggttgccaaaatgcctctccccttcaggtgtggtaaggttttctgttgttgcaagtccctgaagagccaattataatccaaaaaggcacaatcttgagtgccataatcccaaatatttaaatcccaaaagatcaaaatcttgaaaatataattatgaaagaaataatttttaaaaactctttaaaatatatttatttacatttttaaagggggatttattgagaaatttataacacaggacagaacatgtcataggacagtttacataataaaagagacaataataacatatatatatttttgcaagcctaaacgctcaggtatattaacacacaggtataccagctgtgagcaaatgaaccatattcataaagtaatatgtcaaaaagggaaacttattagcacatatcactgtgatttgtaattgtgtgtacccagctgtataactgcaatcacctgaactacaacagacaacatgtcttttgacaagattgattttaaaaaaactgcaatgagtcaccactgcatcaaccctgagttaatcccccaaagaaccaagaaccagagaaatttatctttcacaaatgcagatgtacaaaaaatatctcctcacttattgaggaagttttttgtttgtttgtttggtgtgtgtctgtgtgtgtgttttgtgatggaattgtgtgtgtgtgtgtgtgtgtgtgtgtgtgtgtgtgtgtgtgtgtgtgtgtgttttgtgatggaatttcacccttgctgcctgggctggagtgcaatggcgcaatctcggctcactgcaacctccacctcccaggttcaagtgattctcctgcctcagcccccggagtagctggaattacaggcgcgtgccaccaccgccgctaattttttgtatttttagtagagacggggtttcaccatgttggccaggctggtcttgaactcctgacatcaggtgatctgcccgcctcggcctcccaaagtgctgggattacaggcgtgagccaccgcgcctggctagaagtttttacgtacacgtacaatgcttacatacaaagtcaatgttgtgataatacactttcatggagtcacatttcaaaaaatgcataaagcaaattagaactctctaaaagtctttacacaatgtataactgcagtgtttaaaatgatgcaaagataaaaatacatagcgtaaagaattgtaaaaaaaaataatgctgacaatttaaaatagtgaaaaaacctaaaaaacaaatgacaacaaaaaagtaaaaaaaaaaaaaaaaaaagatatgaaaacgtgtactacaggcatagattatagacaattattcaaagatagtccagaggttctggccaatttttatgatcactaactatattttaaggtattgcatcatgtcacttgaggtcagcatttcgagaatagcctggccaacatggcaaaacttgtctctactaaaaatacaaaaattagccaggcatggtggcacacttccgtaatcccagctactcgggatgctgaggcactagaatcacttgagctcgagaggtagaggttgcagtgagctgagattgcgctgagcctagatcgtgccactgtactccagcttgggttacagagtaagactgtctcaaaaacagaaagaagggaaggaagggaaggaagggaaggaatggaagggaagggaaggaaggaaggagaaagagaaagaaagaaagaaagaaagaaagaaagaaagaaagaaagaaagaaagaaagaaagagagagaaagaaagaaagaagagaaaagaaaggaaggaaggaaggaaggaaggaaggaaggaagggaggaaagaaagagagaaaagaaaagaggaaggggaaagggaaggaaggaaaggaaaggatggaagaagaaagaaagaaagaaagaaagaaagaaagaaagaaagaaagaaagaaagaaagaaaagaaaagaggaaggggaaagggaaggaaggaaagaaaaggatggaagaagaaagaaaggaagagaaagaaagaaagaaaaagaaaagagagagaaaggaaaggaaaggaaaggagaggagaggagaggaggggaggggagaggtgaggagaggagaggaaaggaaaggaacccattccctgggcactcatatgcagactacaaatttgatagaaacaatgctggtaactgaatgggacactgttgtgtaagtatcttcttatcttaccatgcacatacttgtttctgaaccagtcagtaactttgctgacttcttcaggcaactgcatggagctttaattcattaaaagctcccagaatgccatcaactggaaagaatgccaatgcaggtaaatgacacattttcaaactaaagttttcctcattgccgtacctcatggccaattgattcttcttaattttctgtcaaatacactcgggtgaatggaaaaaaaaacaaactttattggaaacaccttgaaattcatttttagaaaccttaattgcacctaattccaaatctgtcattatggtttggggattcaattgaaattcattttattctgcataaagacagtaagagggtgccaaggtgccaaggtgtgcagatcacttgaggtcaggagtgcgagaccagcctggccaacatggtggaactccgtctctactaaacatacaaaaattagctgggcatgggggtactgcacctgtagtcccaagtactagggagaatgaggtgggaggatcacttgaaactaggagacagaggttgcaagtgatccaagatcgtgccactgcactccaaccagggcggcagagtgaaactccacctcaaaaaaacaaaaaaaaagacaataacaaaataatagtttcacctgacattatgcaatcaatttgtgattgtgatttttcaggattttagatgttagggattgtagactttaggaatttagactttaagaacactgatctttcaggattttagcattctggattatggcatctgggattgtgttttttgggattacaatccaaactcaaaggatcttcttgtcatccacctaccttgtcatttaacagatgatattagtcaaacgtcaaactatctcaaaattagggttagaatttaagtctctagactcccagtttagacagtgccccatcctacccctctgccttcttgttgagccatttgagaagaggccctcggagtagtggtcatggtagtaaaagataaggtcatggcatgtccataaggagaaagggtaaaagggcatgacaaggcacagtctgagcacctgcattggtattgatagcagtatctggggctacacccgtgggatgtagagagatgctatcttcccacagagaaacacatacacagaggttatgcttcctctcactagagtaaactcaaattctacctttttttggaagccctcccggatctgaatctatcaaacaaaattaaattcccatagaatttattgcttgaaacattgttgtaaagatcaagggagataatgcatattggaatgctttgtagagggtgacgtattatagtattattaatgagaatcctcagttaaatatgagaattcttgcctcctagacatggtgtctgctttgacatgaaaggaaacatgaaaaagatgctaccatcttaacctgtggttaatatttctgaactttatttatagaattaaaattgaagggggtctatgaagaaagagtaaatcaacttaaactggcatcaggattttggctttattgtctattttcatcttggtttatacatcatgctcatagtctatagtagttaattttcccttatataacaaaataaggataaggtggtctcaaccgattctgaaaggttctatctagcaaaaagtgatatagtctctcgggttgttgaattcccagaacataactagaacctctgagctgtcaaatattgggtcgatttcatcattctgtagtagatttttgacaactgtccaatgaaaaagctctaaaaaaaaatgaagacttactgaatcatattttttcagaggaattgcttgactcagaaatggtagtcagcactaagagagaacgaaaacagatctttccctgatctatactgtgaaagtagcacagaagcactttgaaactcatcttcacaaggagcaggtaacttccaaatcctaatacaaatgccaggatcactcagttcaataaaactcaccagcagtcaggcatgcacctttccatctcaaccaacagtaccgaaacaacttagagaaacagcctgaacagtgaagaatgaagcccctggttcaccgaagttcaatttctcctttagagtctcacaaagaaatatgggctttagaagcagccaattaagcccacctgtccctgaggaaattcggccagtttatattcattgagcagtgagtggatgaagaatcatctgcaagttgttctcagggaacagatttcttacatgaaatcaaagtcctttctttgatgtatctgccactacccacagtaacaccccagtgccagtcttcagagagatctcccttacatagtttacagagaaaatacagtatatccacttatgctcagctactacaagcaactgaaaaacaaacacactcactaagactcatgtggacaaacctgcttgtacatatagaaaatctgaagcaatgtcatcgtgtttgaaagctgatagacgtgtcaaggtacttctcacttatcacagacaaaaaataaagcacaatttacttttatttataagcccacctgattctaactcgaataaggaaggggaacagtttatttcaagatggtcttgtagagaaataagttttcatttaacctgtggtgctgttacgttcaaatgctgcattagagctccctgatgttgggcagtagccaccaatcactggaatacaggccttagttacaagttaagaaaatatttgcctttggagcaacaaacatcaagtgagttgtacaggccattaaagaaagcctatcagagaccatttggccatttgtccattgaccgtgtatggtaatcttttgtcatttttagaaagaataggtcaggaacttcaacaacccaccactctacttctttccaggagcttgacaccatcataatgtctctgatctcagaaacccaagtagaaatcaccaaatctcaagaagcgattcataaagagcttactcggcagactttcaagtcagaaactgctgttgtctatagcccttctatgccacatttactttttttattgacaatgaaactgtgaaagggctatgtggaccctggctgcatcttttctcagcctgccttgtgggtgagtttccctgtacatacgtctgttattgtacttggaaagtggcaccatgactctgtttatgaagactggtcccaaaactggataaagtcctagaagattgtgttaggcattcccccttagttgctggatcatttgttggtgagggagtgtgtatagggcaacaactaataaggtctgggaactcagggaagtggctgttaatcaacttgtactccaacacctagatataatcatatagtttgcccatctcttaggtacttgaaatccagtattctagagggacaactttgataacaaaaagtagctgtgcccattaataaagttttggtccaggtgaagagcacatacactcattagaatacagaggatcagcccggcaacttgcaggctgtgtttagcactctccttattttctcaaagcctttgctctttagtgacatagggatgaagatacctaccttgcaagggtgtgatgagaatcaaacaggacaatgctgtttaattggatgaaacagaaattattctgctcagcattgtggttacaatgtagaagttgtgccgtaattgctggaatataatgatacactagagaatataatggtacactaagcaagatctcatccaatttcctcattctacaaataagaacctctgggtgcagggatgtttataatttccagtggttgcccaatagattaatcacaaattcaaaagaggaaagcaggtttcctgtctctcagtggaacatccttaaccctacattatactatatcgcttttatccttttacaaagaatttaccataactttgtccctgtggtacattaacaagttatgcactcatgttaataactttttgctgtagaacacatagtagtgaatagggaaaagtaaacaaaatgaagtttatgcataaaggataagacctatagggatgtgcttaatgaaaggacttggggtgtgagataggaaattccaattaaaatagcacacacttaaatacaggctataacccattctttcaagaatgttcagtcagaatggtgttattttctatttcttttcctactaaatatttgccaattattttttgatgagcttgagtgtccaaaagctcaggtaagggaatttattttgacagaacacagatgatcctccctgggaattgctgccactaagtcttctgtgaatctgcattcctctatctggcagctccaagaagatatttgtaaatagcaacgttaagtaaatagccacagcatgaaaagtccttccaccagattagtaccattcctgactgctggggacggcaaactcgcatttaaataaaactcccaaatatgtcacactgctcctcgcctttcatatatttatcctaagtcaaaacaatgtcttgtctttggagaacacaaagggaaacaagcatcaggcctggactttagtcccctgccccacatcttcttaccttcccatctataaatgtgcagtttcattgacgaaagttgtgtttctgcatatttgtgtgtgatttttttcccctatgcacaaactgtcaatagttactaaggcaggagaacatgttctatctttctggaagcagaaaaattagttataatctgtcagataacaactgtttatcaaggaattcttccaattcttccaggagcactaacctttgtttaatatgtcgttgattttctaaactgttaagtatgccttataatggtgaaaacctacatgataccactcactacatcagctaatatctagtttattagaacattaacatttaccactgacaattaactgacaaattgcatgtgtatgtgatttataatgagagatttgaaggtgaacacaagttaagtatttttaaatggcatgtgggaatgctgtagtgaagcctagacccttcttgtccttcccttttcttcttagaagaaacagaccagtactgtgcaagtatgaagcccctcccctctgagcttggtgaactaatctgcaattagccattggaaagcctgtgcataattaattaaacattactattgaagaaagatgtgtacatgtgtatgcagatggagaacttgagaataagataaggcaaagtgttctaaacaatgaaaaaacattgtgttgctccattgttggtgcaaggtaagattcatgtttattcctttacagggactatattagtctggtagggctgccaaaacaaaaatgccacagactgggagatttaaacaacagaaatatattttctcacaattctgggactagaagtccaaggtcaatgtgtcagcaggttttgtgtctggtgaggcctttcctcctggcttgtaaactgccatcttttcactatgttcttacatggccttagatcttgcaagtttttagcctttattttacttttgaaattttttgtttttattaaattattgtacatacatttgagatgtgccaatagatataatatgcaccatttaaatcttcaagttacaaataataaaatgatctttaagattgtcaggtttttgaaatatcgtaagaatctataaatgtacaatcatttatttatttaaataattttcttcattcaacatacatttaatatctccaactattgacctactattatttctatcatagagctgttgctatatactattcaaaaaaactaaaaatgtttttataaattgaacatggaaaaagactactgaatgtggcaaagccacaataatttatatagatgtatatgtacttgcttatgcatcaaaaatttttagtgcatatgtccctcaaaggcaaatattttagtaggccgtcccatcaattgactggaacttaaaagtgtttgatgataacaatgctttctttttgacaaaaataagttgcatattactaaattcagattaatattttacaaagtacttcgcaattttttcactatacgttatttccaaagttaaaaacataaaataactctctccaatgaaatactcagatgaaatgaggatcacatccttttcctattttacttttcttatctttgtattctgtttgtggctatatatgcagatatccttgaaattagaaatatagccagagggttttcctcctaataaaattgcattttaaatgaatattaatagcgtaactttttatttttaacctcttttattacaaacattttaaatatatgccaaagtagatatagtaacataatgaacattcgtatttccatcaaatagcttcaacaaatggccaatatcgctttatctatttctccaactatgtaattattttgaaacaaaccccagacatcttaaaacttctgtgaatactttacagtgtatctttaagagattactatttttaaaaacataaccacaatatcattataatctcaaataacaataatcactgtataccatcaaatatttagccactaatcaaatttccagtttggttggattacttttatttaatatctctacaatattttttgtaggtttcctctctcactttcattcttcaatttatttattgaagaacctggaccatttttcctggaacattttctatacattagattttgctgattgtattcctatgtttctttgtctcctgtgcttaccataaaataatagactaagcgattaggttttgtattatttttggcaaaaatgcacatagttgagttttattttctttcttgcaccatatctgaaggcatgtaaaaaggggttgcttttctttttgtgattaatcaataggtttaggtgttgccaccttcacccattcactaaaaagtttcccatgtggttttcacttactgctatcagcagccattcatatttattacaaagatccattaattacaaagatccaaaaatctctattgtaatgtggcaatattccaatctaattcttaacctttaatacattatttaataaatataaataaagtataattattttcatttcttctttcaggaaattccaatttaaggactttgcattattcttcatagcacttatttaaaattattgtaagagaggtccctttttgtctctgtgtgagactggttggttgtgtacttatagaggagagttttacttccatttgaatgataagctcttgagggcaggcaacaacacatcttatatttatttttatctagcacctaccatgatgtagtttacattgcagacactcaagaaagtcgtggtaatttggtgggttagaatgctttggcacctgccaacctcatctttgggccatttcctttaccctacccctcctccaagtatggccctgttcatcatttttaccacatcatgtgggatagtgaagtgtaaagtcattgattgatagttggtgtttatgcattaggttctacctcactctagaaagtaactgttgatattttaaattctgaaacagaaagatccacttgtgctggtgtcaactattcaattaaagtcaatccatttctaacaaagtttttaaaaaggcagagataaataatttactgatgttagttactactaactactaatgtcagttactgcacagtagtattttattcatttatataaaggatctttaaaatatctttcaatataatataatatataatatatattaatataataataaattaatctgaaaatgattttcaggaaaggaatacgttgagtcattgtgtgattagtatctctacaacgtttacataggggtttacacaaataggcagtaatatttattactgctaaaacgaaatcgaagacatattactgtaatactgtaaggagttcatggtccagtctgggagacagaatctatggtgataaacaaatgataatacatatataatggtgtagtcaggattcagagaacactattagacctcactgagattgttataattattataagtcatttgagactttacctcaggagagatcagtaaaaaatttctcctcatctcagtttctagaagtggttattatattccatggatatgtaatggcagaatttagatcaaatttttatcaaaagttcagataggacaaaaatgccacatatggatagaaatttccagttttccaatgatagatgacatccatttttaagtcagttttagtatcagtaaatcagtttgaaaggttatataaaaacatatgtcataaacttcttctttacatcccttactcagaatctgcctaaattaataacagaattttctaggctttgatgacaggttattctcaggaaactgccaccacagcacctaacaattcgatgtcatgatgcttactccagattgagtgctacagatttgttatattcctatttgagttcaaaactgaataagaaatggcagttgcattttaatttgaggtaacatttagaaatgatttaagaaatgtgattaatgacaacacagatttattagattcaattattaggaggcttgtttttacctttttcatgtttcaagcaggcactaaataattctgtcaacctgttataagacatttataaatggcattgcatagaattatttacatgtctcttgaacatgataaagtacttatcataataaattattatggaaaaggcagtgctattaatcacttgttaaatgttaataacatttaccaacatttatttcttttaaagcagcaagaaaaaataggtatttcttttttttctgtaatataatttttattgagactgaataaagcatttgaaacactgaatgagtcgtttcatatactaaatttggagtttttcatttgagataacaaagcagtgggaaatcaatgctatgacaactaacatttgactataaaacttaaagtataataataataaaaaaattaaaactctgtattccaaaaaaaaaaattgcttcttagttttacttctattttagacattatctactgaatctcttcaatagtcaatttggatgttactcccttttacatttttaataaaaccatgagcatttatcttttttgcattttcaatataatttaataacaacttttggttatattgatatttattgtttaattgtacttttaaacattgttttgctgccaagtaaagtaataatcacattaaaaaaaaaagaaagttcctataggtactttttcatgtttagcatgttattcaatattgtttacaagtataaatttacaacaaatggaaatttaaaaataggtatttcattttgaaaaattatcaactgaaataaggattttattatttccagattccagattctcaactctagacttaaatagttaaatcttttacctcttaaaaattcttgtatttattggctttaatgtagatgaaaataacgtatttgagttttacaaaaatttagcttctagagtgcaaaagcttttgagaacgtaagtggggtagaaaaattaaaactagattgtatattataaagcactttctgtactacttaaccaggaaagcatctaaatatttattcactttccaatgtagtacatttatgccatcttctggcaatggttcctcaagctgggaatattcaaattaacacgcatcaaaataacttaatatttccttacagagtcactagctgacattccttaaatagtatgaagtcctgtaaaattggaacaaggccacaatagtggctatctttagtaaacagagaaaaggtgatattacaaaatcactgttacgttagttggctagtcccaatatatcagaacagacgctaaacattcacaaaacctgtaaaagttaaacatttggaaaacaccaagtgttcatgaagagatgtagcaatgacagctctatttcacacagtgctgatagaaatataacttggaaaactgaatgtgcctctccaaaatttcgtacgttaaaaccctaatccccaatattatggcatttagagatggttcctttgggtggtaatgagataagtatttttttcctttttttctttctaatttttgtgggtacataatagatgtatacatttatggagtacatgggatattttgatgcaggtatgcaaggcatgataatcacaccattgagaatgggttatctatcccctcatgcatttatcctttgagttacaaacaatccaattacactcttttagttatttttaaaagtataattaagttattattgactatagtcaccctattgtgctatcaaatagcagatcttatttattctttctatttttttttttgtacccattaaccatccccacctccccacccagttccccaccacccttcccagcctctggtaaccaaccttctactctctatgtccatgagatcaactgttttgatttttagatcccacaaataagagaggacatgtaatatttgtctttctgtgcctggcttttttcacttaacatagtgatctccagttccatccatgttgttgcaaacgactggatctcatttttttatgcctgaacatgaatgtggaaaaaacagcctttcctataagatctggaacactacaaggatgtccatgtcatcactgttattcaacatagtagtggaagtcctagctagagattagcatatttatttttaaaacatgagttaacctgcttcctctctctctctgttctctgccatgtaaggacataagaagatacaatgtaaagatgtatagaagctactgtttcagtctgtaaaccaggaagagggccctcaccagaactcaaacatgccgacaacctgatctcagacttccagcctccagaactgtgaaaaataaatttctgtcgtttaagctatgcaatttatggtatttttgatagagtggcccaaactaagttagtattgtccaataaaagtaaataagatcatactttatgactcacaacttcactccttagtatataacaaagcaatactaactgcatttatttcttttcttggaaagataactaggtcactttatatcccatctaacaatattttataaaatctggtttaatgtctgtaatctttttcaatagcttggtatgtaaacgaggtcacttctttttcatctcttcaaatttgattgcttagaacttcatgcatcctgattagcagtatgtccactttcccctttttaaggtcttttagctttcattaaccaagaaaaggagagtttactcgacacaaaaaaatcagttcttcccccaaaacctagccacacaaagagctagaaagtccagttctaacaccattgtgttgttgccacatggagtcatagttgaactctctggttctgtgagatctaatgttacttgttccaaactgaggtgagttctttggtggtttggatactttatgagacacaaggataccctggtctagggcttcaactttaccattgtgtatttatgtgtctgtgtgtttaacttcccactcaaactatcagcccttgttcttccaagtgaaatgagacctcctgggagtacgggcatatttccaaaaactttgtgacatatgccaatgatatttcctttgaacaagagtccactgatgaaagtgccataatagctttcatgaataaatgacaatctactttttaaaattttagaacagctttaggtttcagcaaaattgagcagaaaaaaatagagttccatatactccctgcccctacatttgcatagcctactccattttcaacatcccccaccagagaggtacatttactataactgataaacccacactgacacattattatcacctaaagtccatagtttacatgagagttcactcttggtgtttgatatactttggatgtttgttccctccaaatctcatattgaaatgtaatctccaaagttgtaggtggggtctggtgggaggtgtttgagtcatgagagcgggtctctcatgaatggcttggtatccgcccccgccccccccccgcccccccgcagtaatgaattcgcaagagatctggttgtttaaaacagctttagcacctctgcacttctctcactccctctctcaccatatgatgcgctggctccctttcaccttccaccatgactgtaagctttctgaatccctcaccagaagcagatgcccatactatgttttgggtagagcataaaaaccataggccaaataaacctcttttctttataaattactcagtctcaggtatccattatagcaacaaaaacagactaatacagtgttgtacattttatgggtttgggaaaatgtttaatgaatgacatgtatccatcattatagtaccatacaaagtagtttcactgccctaaaaaaactcctctgtgttccacctattcatccctccccaatcccaacccctggcagccaatgaaacttttacaatctccatagttttgccttttccagaatgtcataaagttggaatcattcagtatgtagcttctcagaattggctttcacttagtaatatgcatttaagtttcctctgtgtattttcatggcttgatagcgcattttttgatagcactggataataaatagtccattgtcaggatgtaccaattcatttaaccatccaccttctgaaggatatcttggttgcttccaagttttgccaattatgaataaagctataaacattcaactgccagtttttgtgtggacataagttttcaacttatttgtgtaaacaccaaggagagtcattgctggatcatatggtaggagtatgtttagttttgtaaggaactgccgaagtgtcttcaaaattggatgtactactttgcattaccatcagcaaaaaaacaagagctcttgttgctgcacatccttgccagtatttgttgttgtcattgttctgggtttggtttaatctgaaagagaatggaacctgggccccagtccagaaagcacagaatcttagccactaggccacagggcgaggtgctcttttgtcaatgctgcagggaatagaagcaggcagtttaagcattttaaaggattttaacttgtttcaggggtgagctcaattggaaggttgtttagctaattacctagatgttaccatttcaaagacaggatcagatttacatctccaaaggactgtgaagtccagcaggacatttaaagggtattctctgatattgggtcaataaatcatccatgtcatttattagttatggtttagaagaaaaactttgttggatctgtattttataatctcagtagttttcttctcattctgtagttgttccatttgttttctctcctccaaatttaaagacgtttaccctcttttgagagaaaaaaaagtttgcattgtggaatttcaaaaatctctgccgaagagcttatgggagctgagggaacaagcagaaagggatgaattcaaatgacaggggtacaaggaggaggagcagttggaggcaaaatggagaaagtctccgaagtcttttttcatttgaaataactttagacaatcttgatttcctcttgcaaagaaacttctttatcaaaaactcttttagaagcttctaagtaacattgaaaaattgctctcccagttattttggttttattttaaagccagctttatttttattattagagcatgcagataaactattttaaatgtttcaaagatatcctatttaggctgttgtagttaggggtctttgtgctttaaaaccatttttctagatattgacaggaggtggcaccataagtattgtacatgaattcacctgaagtttctaaagttggatgtctcctttagaagtacaaatgcaaattagattttccctttgaatgaccaaaaagatctagtgggaggaattttggttactccagatgaaagtgcagatttgaccactgagccaagcttcagaatctggccagttttaaagattacaaatttttcatttaagccacaaaaatttcattttctctcttcaaagaaaacctgttttctccttgaccaaatttcaagtgagtgaaaaggtttcaaaccctaagaaataagacaaacaaaacctttactgcagagaaaaatgaaaacgacaaatatgcagtccacagaatccatagaattaaagctctgctttaaagtaggagttttctcaaaggactcctcttgaggaaactcctaccttaaaatcagagcatcaattccagctccattgagcatggaattgggttgcttgaataaagtttcaatctcaaactgaaatcagggcaactgaaaacctgagaggagctttgacagagacccccatcagctgcaacaaggtcgggtgaatgaaaagcattccctcttggcataattaatttagggagtcctgaaattttattttcttttacatgtacaaatattagaagtttctttctataaaaccaagtattattaaatcaaatttagcctaaagcagcctccttacatattttaaggtcagcctaaaagtttctctgtacatcatgaagtataacttaaatgggttgtacatagactgtagcctactcttgtgccaatcactgagttttggccaatcaactgtggccaactgttcaaatcatattcaaataaggcaaaccctgagctgtaaccaataccaaaatcaaatttctacttcaaaaataagtcttttttgacctctaactttgggatgctacagagggcccttgaagcatccaaaagagaggtaaacaggattatttgacatgttaagttacatgcaaagcattgccaaataagaaataatgtttaactttcttcagcctatattttaatgaatgttattaatatatgttcaaaaattgtatggaattcctaaaattctaatatgtctgagtatatgctatcaatcataattatgggtaagttactgtagaccacagaaataaccacatttccttgtcaattgtgtctttaactgtgactatttaaagccatttccatagttaactgcttgattctgatgcagtttctgaaaacttcacaagcatgcaacatccaagaatacgatgtctttaaggaggttcaggaaaggatggaaaggaccctgagaagcactccttagtacaggtttctaatcactttagaatcatatcatttggactgggtaagaattcccagaactttaatgaagagactgactagtatataaaactgctcacccaagcagaacaaaaattaatatcaagaaaatattttgcaggtttccatgctaaatctgccagtattgaaaatgtttagatatacaatttgaatgaactccatagtctaagtaaaattacctatgataacccatcagttatcagtgctatgcacctaaattggagaaacaactgttattcaagaagacacaagtctattgttaagcatagactcatggaaaaccaggatggctatcttgtccttcttaagtccttaaagctatggttattaaaagttctaaatccaaattaaatatatatattggtatgatgacttctaagttgctaaaatagtttatgaccaatgtttggtttgtcaaacccatattcttgggaagacaaataaaaatttcaggtacattctactatctgatgggctatttaaacacttctaaagggatttcattcaattgtcattttcagtgcatgttttctggttgtacaaaacgttctcatgcaagaaggctaatgttataacagtagctcattataccaaagtgtctcttcaccaggtaaagaaagattttaatggttcactgactgagagcaattaacctcttcacaatatagaacatgaagattagaccttctaagaatatcattgaaagactacccttgccatccacactgcagcaaaacttctggaccttgaaccttgggttcataatctcacgacttagaggggtccctccttactcttggaactataaacacattggaaaccttaaggtaaagctaaccagggaagcttctcctcagaagaaggtggcatccttgatgtagacagctttatcccaacatcacagataaagacttctctactatcatgagactcttatctttgaatatttttcccttgcttatgcctctatgaatgatagaagtgaaagggggggtctattgtgtgcactcatggggtatagtttatttgtgaaaaattttgcagccagccttatatatggataaccttatgccttgatagatggaagatgaaggcctaatgtacttgagaaatgttaatggtacataccttgcctcacagtcagtcagaaacagaaaactggtccactcctcttagccaatatcataggctaaaaagaacactgccaggaggtcttcactcttctgaagggcattgtttgttaagtcctttttcccatggtttagagtaaatgaggtaatgattagaaatttattcctcatgatatgctttatagcagattctactgtagaggctctggttacataacagactgtaaagtctcctgtgaaagttatgctgaataatagaattgctctggattagtaaccggctaaacagatgtatctatgcaatgctggcaattcttgttgcccatgaagaaatacatcacatccagtattacagagattcagttatatggtattaatgaagagactgcttaaagtgggtagactcttcatctagctcattctttggtctatttgattttagttggtttggtttatggggaacctggctaaggagcagactccaaactcttggtgttattctcctgatagtcttaatagtagtctccctggtacactgtattctctcaaaagttttaaatacttccatgcagccatctctaaaatgtcagatggtctctctttaactggagcgacaagagctgaaagaaatatgtgaccaaaaagtcactgtaacccacgaatgacatgctgagaccagaaatccaaaatgatggtaactgagagtggcactaaggccctaagttttggtcacactctcaccatgagaatctgaccaaaaggggggaattttaaaacaaattatgggagcccattgtttgccccaacagaccagaccaaaccaaaatggagtcatttatgctaaatgtgacataatcaaactaagactttaaggaaacacagaagatttttagaacagaccatgttttgtttctctcctgcagcataagaaggtattctctactccaaaccttacaaaaataataatagtaataacgttaagaccttgtttccaccttacaaaacccgcagttctgctatttcccagtgggtttcaaaaccaagtaagtacatttactatggtgatagtgacatcaatgactaaagttttggtaaatctctcacaattgagaggatgaaaaaatgggggaattgttaaatcaagtgcctaaagctacctccttatatattctaagttcagcctaaaggtttctctgtacatcatgaactataacctaaatggagttatatatagactgtagcctgctcttgtgccaatcactgagttttggccaatcaacgatggccaactgttcaaaccatgttcaaacaaggcaaatgccaaactgtaactaaccccgctgtttctgtacctcacttccattttctgtatgtcttttcctttttctgtccataaatcttcttctaccatgtggctgcactggagtctctgagtcttctctggctcaggaggctgcctgatttgtaaatcattctttgctcaattaaactcttaaatttaattcagctacagtttttcttttaacagtacatatggtcaagtaattttctacaaggccactaagaagacacaaggtggaaagagtagtctctccaataaatggtgctgggaaaactggatatccacacaaagaacaatgaaactggtctcttatcctacaccatacacaaaaatcaactcaaaatggattaaatacctaaatataagacctgaaatgtaaaactctttaaaataaagaggatggggaagctatttgatattggccttggtagtgactttttggatatcacaccaaaagcacaggcaaaagcaaaaataaataactaggactatatcaaactaaaaagcttctccacagcaaataaaaccattaacaaattgaaaaggcagctaatagattgagagaaattatttgtgaaccatatatctaataaggggttaatatcccaaatatataagcaactaaaaggaaactaaaactattttcctcaaaatatacttttttggcatattttgaaattcaggcaaatgtgcctattcagaggacctgcagacaggaatagctctgaaaagctgtcatttgtggagtatatatgcattgctacattagcaaaataaatagccaggctttctttgaggccctaccccttatccagatctggaaataattaactcaaccacaagctgctacctattctttctgagagctgttgcctttgagatttcatctacatgacaagattgcctttaccccttgcctttatttctctctccctcccataatcttgaagcatggtcttgccatgctttaagcccctattcttctgttacctcaagatggtataaaaatgtcaactatctggccctgtctttgagattttcatattttgtatgagtcccatgcacacatgtgcatattaataaattttctatgtcttttctcctattaatctgctttttgtcagttaattttcagtgaaccttcagaggtcaaaggagacatttttccttttagccccttcagaactcacaaaattatgtagcaaaatcataatataattaaagaatgggcaaaggacctgaatagactttttccaaagaaggcataaaaatggccaataactgtatgaaaagatgctcaactttattaatcatcagataaatgtgaatcaaaagcacaattaaatatcatctcatacctgttaggatggatattatcaaaaagtcaagagataacaagggttttcaagggtgtggagaagagggaactgttgtacactcttgatgagaatctaaattggtatcgctattatggaaaacagtatggaggttcctcaaaaacttaaaaatataactaccttaagatccagaaatccctcttctgtgtgtatactcaaaaggtgtctgtgctcccatgatgagcattattcacagtagccaagatatgggaacaacctgagtgtagtgtgagtgggcagttgaatggataaattgtggtagatatataatggaatattaaccttaaaataaaagatactgccatttgtaacaacatggataaagatggaagacattttgccaagtgaaataagacagacacaagaagaaaaatactgcctgatcttgtatgtggaatctttttttaaaaaaaaaaaaagagtcaaatacttagcgcaaggaggaaatggggatgtgtaggtcaaaggtacaacttacagttacttgggttaaataaataagtctgagatctaatgcacagcaggaggactatacttagcaatattgtatactgaaattttactaagagtttattttagatgctcttatcacaaacaaaggtaaatatggatggatggtgatggatacgtaaaattgtttacctgtggtaattatttcactatggatatgtacatcaaaacatcttgctgctcacctaaaattaatacaatgaaaacggaaatgctcctgacggggcaaggaggagaaagctaggtgacttggagccagcgctgctgggtacctagcgtcttcaaggaactgccgcgcgccgccagtcgggggcgcgggctggcaccgggctccctccgcgggccagggccgcggtaggggcgggatccgcgcgagcctcgggccctgggagcaggagccgaagtcaccgggtgctggccctccgcccctccctgttcggcaccacctcccgcagcctggggaggggctgggacggagccagccctgtcgagcggggcggagcgggcgcggggccggcggcgaaggtcaggggtggaatcgacgtcgctgcggctgcggacgacccccacccggccggcggcctccgcagacccaccttggtcgcgcggcagggggcgcgcagagccccgagggagcgagtcccagtgcgtgggggctcggtggcttctcccctcgggaggtcggactcctggctccccggacccgcctggcgtcctcgggcggcagcggcatccaggaatggcttcggcgggcagcggcatggaggaggtgcgcgtgtcggtgttgactccccttgaagctggtcgggctgttgtgcatcttcctgacgctgtatctggatctgggggcggtgctgagcccggcctggatcacagctgaccaccagtactacctgtcgttgtgggagtcctgccggaaacccgccagcttggacatctggcactgcgagtccacgctcagcagcggtgagggcccggcgcaccgcgacccctgcctcccgccccggactgccttgcgccctactgccaggagagtcaccacctgtccccacctctccgcgtcccctgccctggcccgtcccaccgcgtccaggcccttctcggatcctgaggctccaaccacctccctggcgtccacccctcttccctccccatccctggccgccaaacctaaagcgacagcccacgtcctctccctcccctgtggccattcctcctattctgcagtaacacgtaacgctattttgggtatttgttatcatttgaggcgagagccatgtggctgtgtaaaaaatgcgacgccttccacaccccagttaaaaaagaagcaggcaaaaacgccccaactccaccgagatgctgcgggggttctctgttggtcttccccactcttttttccctcctctctcgaggacgaatttgcctaggtttacctctcagtgttcacatttctgcctgttccactccatcttatctggattttcaccaattaactcagattgggattttatttccttaaacttttgggagataggaagagttgggagagggaggggcttactttcctttgtggtctttggttgtgagttgccctcccatctccccagttcaaagtacctctcctctccagccagacctttatttatttctcctttgcaagagctgctcacagatggcctaggactttattgcttattcggccagtactaaaagctgccaatggatccccactgtgggagatcccaggacagagttgtctgacattggagtttggagtggaaacaaaatggtataaagacattattggaatgattgttcagtttaaatagggatagttattgtataattagataatattgtattaatgttaaatttcctgatttgctcattgacagtggttaaataaaataatgtgttttctggccaggcgcggtggctcatgcctgtaatcccagcactttgggaggccgaggcaggcagatcacctgaggtcaggagatcaaggccagcctggccaacatggcgaaaccctgtctctactaaaaatacaaaaaatagccaggtgtggtgttgggcgcctgtaatcccagctactcaggaggctgaggctgggagaatcccttgaacccgggaggcggagtttgcagtgagctgagatcaccattgcactccagcctgggcaacagagccagactctgtctcaaaaaaaaaatatatatatatatatttatatatatatttatatatatttttatatatatttatatatatttatatatatatttataagtatatatatattcctttttttagtcaatacacactgaaatatttaggggtacagggtcacaacatatgcagcttactctcaaatggtagaaaatatgtatatatggtagagagaaaaaatgataaatgagacaatgttacaaattgatgaatatgggtaaaggacttttcttgtactatttttgtactattcttgcaaattttctgtaagttttaaagcatttaaatttttaattaaaaatatttttccctggtataaagtacttttagcacaatgaattcaaacaagtgcttgccttttctgtaaaggagaatgataaagtaggatgaaaagttattaagtgtgtgaaaaccgttagattatctaaaatttatattttttgaaaacatacagtgtgaaaaaacagattttatgttttaaacatatgagccatattggactgtaaacattccatgatatttgatatacatagtgaacgctttcaataacatttagatgacatttgcaaataatactttattctatttagagtatataatagctcatgattggtctaggaagatgaatactttaagacaaagccagtatattaaaacacacacatatatgcatgttcaaccacacactcacagaaaattgtgtgaagccctccctattagagtgagacacaagatgtatttgtcttctagcatatgtgacatcacttgtgtagcatctagtgttatttttgtgctgccctggactggatctttatataatggctacctctggtaatgcaatttccagctgtggagcagttctatggaattttcacccccaccttgtgctttcctatccatgctctctttgaatagcatgtagtctagagtaaagaatggtgagccaggtgcagtggctcatgcctgtaatcccaacactttgggaggccaaggcatgtggatcacctgaggacaggagttcgggaccagcctggccaacatggtgaaaccctgtctctactaaaaatacaaaaattagccgggcgtggtggcaggtgcctgtaatcccagctactcgggaggctgaggcaggagaatcacttgaacccgggaggcggaggttgcagtgagccaagatcatgccatcgcactccagcctgcaggacaagagcgagactttgtctcaaaaaaaaaaaaaaaaatggtgaagaagagtattctctcagagtgggaagggaagtccagatatgtcttttcttttgtatgagaagtaaaaccttttaaaatactatcagcatctattaacttcctccatactttgtctctcattaggcaaagcaatgatgttatctataaccttctagaacaaaactgtgtgaatcaaatccttccccctggccaaggagataaatcctagctcagcagcgtcctatggaaatggggctctcaaagacagtacagcacacaggaaagtgagcctagctctccaaccaacataatattattagttaaaagcatatttcagagttcctaacagggtaatttttgtttgtttgtttttgtttaaaatgcccatgcgtattttattaataaaaactaacagtgccaagttaaacaagtcaaacaattaaagtttctttatattccataaaatattacagaaaagtttatttgtgtttcaataaaaagactttcgctttagaacaggcagctaatagcaactgtgcagttaatgggttttgtgaataaattttaaaagagactactgcctgtccttaaattccttgttctttttattaaaaaaaaaagaactattaaaaatgattgacaaattttgagttaaaaaattgttaaaacattctttatatttaatttcaattttataatagattacaggaagatgcttatgaaacaaatacatttgtttcagtatatgtctttaaatgatagactgataagtatgtaaacaactatataataaaaggtttccaaacgctgcctgtaagaaatcaggcaaattttaccataagcaataaaccattccaagccttccaaacagtctccatagccacaccagcgtggcagtaagctttaaccaaacaaaaacaaacaaacaaacaaaagcactttgcaatttgttgctgcaaaatagggagagaaaagagtgtataaacttgatggaatcacgacagtcaatataatttaagagaaaataaagttaataaggttgatggtgtttattgtttaaaatgtcgaattctgctgtttgcttggggctctggacaccgtaccactgaacaaatggaaaactccacagagtctcgctatctgccagtgggggcgccgtccaaactcacggcaaataaacggcatcaggtgctcaccatccacaacaagagggcgttttattttcatgcatgtggatgaaatacaatttcttcagcaaactcagcaaaaactgttcaggggcaaaaatgaactctgcacttaaaagaaaaataaaaaatgaaagcacaaaatactaaaaagtaaataaacgctctgcatcagcacactggtatcaaaacacacatccacagcacgtcctaatcctacaggaaacaatccttgcttatcagaggtgcatatctaaattaaatagcttaccaatatcttcttgggagtaggacaaaaggaaacagaaaacctacattaaaaaaaaagtttcttttccctaaatgttttcctgaagctgaatttgaagtggggaggacgtcagtcgtccttgtcattctcgttgaagtcatcatcctcctcgtcgtcctccccgacgtaggacaccggggtctccaccctggagccgctgtactgagacctcttggagcttgtggccagcatcccatctgcaccgttggtcaggtcactggcagagaacctcgtgcctttagacgtggaacctgccgccgtgatgaacacgcctccaacagttccctgagccatttctgtcacatacggctccagcgcctttgggactagacttctggccattttaaggtcttcagcagagcagctcccagactccagccagcaagccatgcccatccgcttcagcacttctatgtcaccttggatttcaaatgtgttgtcaaaattaaacagatactcgagtttgtcgttggagatgctgcagtcgatgacggtcttcttgctggtgttgacgacgatgaagggcaggtggatgaccgagttgggtggtggcggccggctggcctgctgctctgcgtgccggtttctctgcaccaggttcttgaaggcaatttgctgtagaataagttctcgaagttgagactgtttctgttttattctttcaagtctcctctgtctttccacctctaagttctgacattcctgagccgagttggtgggcagaccaatccacttaatctccttcttctccttggagatgatgttcatggccatcagcacgtttaaggcatcatagacgcgccgtcttatgttcttctggtcataagctgactcgtttggtaagatgtggttgtcggcagcactgaactctgctaccagctcgtccgccacttcgttgtaggaagtggtccctttcctctgcaccttctcgcagaccttcatggagaaatgccgcaggcccttgcaattctctcctttcctgttgcgcttccctgcagaccgaggtgaggagtcagaaggctggttctgagaggcaaagtgagtgctgggggtgtgtgagcttcctaccaccagggtgtttgacgctgcaggtctctgaggcataccaatcaccacttgctgggcaatgctgacattggactgtccaaaggtttttggcaagagctgtttcccgagcgggttgacggtggaggggtgaacggccacgagggacaccacgccttttccggaactaaggttctggtctatgaagaccttgagttctccgttggcttcaattagaccggcatcttttgccatgttaccagatccggaaaatcaatgctacaaatgttcaccttcccagagaagaaaaatgatttttctgggcgcagccccggggtcctggcgcaacgtgcaggctcgcggcgtccaccccggacactggcggcgcccgcccggcagaccggtaactctgacaggtgggcttccggggtcctcgccgcgcgcctgtcactaggcctcgggccgcctccgcactaggcgcctcccgcgcgcgccggaaccgggtccccgcgggccgccgtggggcggcctcccctcccccgccctgcgcgctccagccgaccctggccccggccccacctccgccgcgggccgcgggcgctgctgtcgaccgggagggccgggcccgggacccccgccccacgattacctggggagcccccaccagcgccgagcgcgcggggtccccgaggcacaggggcgcgctgggcgcgggaaagcgcgggtcggggccgcgcggcgcctacaagcggccggggcacgggatagggtggccaggggtcccgcccgcgccccaggcccccgcccgcggctcccgcggcatcccctgcccgcccgcacctggctacccgatccggccgcgtgggtgggggcgcggagagggcgcggtgcgggggccgggccgggcggtccaggccgcggcggggtccctgccctgggccgagcagcgccggggaccacaggttaatttttaattgctagctgtgtacgtaattcagggatgcagatttcaaatatacgccaaaaaggtaggcaaatctgtgtgaatttttcttttaattcccaatatacttacttttttgttattttcaaaagcttgtcttgcttctttgaatgtgcagacgacttctgtgtactcgccctcaatcttggctagcattttaatactgaattggcttttttcctgtgaagaaaactaaaaagatatataattataagcaaaaaaataatttttttattgagacagtatctcacttagtcactcaggctggagtgcagtggtgattatgtctcactgcaaccttgacctcccgggttcaggtaagcctcccatctcagcctcccgagtagctgggaccacagttgtgcaccaccaccacacctgactaatttttatatttttttgtagagactgggttttgctatgttgctcaggatggttttgaactcctgggctcaagcgatctgcccatctcagcctcccaaagtgctgagattatcataggtgtgagccactgcacctggccaacagagtaatttttttttttttttttgagatagagtctcactctgtcacccaggttggaatgcagtggcatgatctcggctcactgcaacctccgcttcctgggttcacacgattctcctgcctcggcctcccgagcagctggaattacaggtgtgtgccaccatgcccagctaattttttgtatttttagtagagagggggtttcaccatgttggccaggctggtctcaaactcctgacctcaagtgatccatccgccttggcctcccgaagtgctggtattacaggcgtgagccaccacgcctggccgagagtatttttttttttaaacccacatggtaacttaatataccagatgaaaactgctaggtgctctctagaaaacagccagcatcctacacctctttcttggagacagcaatggagtaacacttaattccaaaccactgcatctgctatcttcctcatcatgtgagtacctcctttcagtagcagttcccctgggcagggacagtgacataattaactgtgttatattcagacattagcacattcctgcaaaccaagggtgtttatgatagcactatttatactcattagtataagtagataccccaaggcattctgctgttggacagaagcaaccaaatcaaaacccagcctctagacaatgtctttgtcctgcttcctgaaaataaataaaacttctattgaactgtataatataaacccagagaaccattacttgtatgaaaagataggtgacaaaacaacattgaggagttaagatacatttggccaaacccattccaaaaaagaaataataattttgttttaaataaactttaattatgtatagtgacattttaacacatacaaccctattccactgcccctcagaaaaagaaaattcttctctgtgatgtatggagatattgccacatagataatcaaaatttatacccatgatactctgtgcagtaaataaggcaatagctatatatgcgctcatggagaatcatttttacttttctatacaagtaaatataaaatgtacttcaattacatatatctaaaaagaaatcttctttgtttgtatacataaataaaatgtcaccggaattaaatccctgttaatataaaaggcctataacatttcttaatcttataaatttctaacatatgaaaagtcacattagtgcaagatttttttaaatttgtattttccaaaggagtttttaaagtattcattttccagagaacatcttgaaataaatgaaaaatagaagtgcttttttaagaataaatgtctaatcaatgattttaaactttacttaattatgtatatttcatataatagaaaacagatttttaacctagtatttttttaagtatccaaattggaatcagctagatgacacacaataacaacaatagtaggcccacaatgaatgtttccatccttccacacttcataagcatagccatctaaaaacaaacttcaagcatggctgagtgaagaggtcagtgaattatctttgcaaaaaacaatgataaactggataaaattgtcaaaaaaaattcagtactctggaaaatgacaaaaggcatacaacaaattgaaagtgtttattcaagaaatacagtgaatttgtggcattattagcctgagctcctgccatcctgtctccctacccctagctctgtggtgtagcacttctactgtggtatagcagcaggctatgagactagatgatggagagggctgattttaaagtgcagaaaaatctatgctgaggggtgttgttgaaaacaataactgttttagtggcaaacaattgaggaagatcaacatcacagctaaattggggttgcaatatgagttggggtgagctacagataagaaagtcagctgtaaatttaacagagagatccagcaataagacagccatagtgaactttaagaagctcccatatatcccaactgttatgaaaggctatattcactcaggaaagtccagagattgccctagctagcaacgtgtccctggctacatgtgaagccttgtgtatccagaaagtaaaagccaaggcagatttgtaaacttcctgaactttgaatgtgactatatttggagacagggcctttatggaggtaattaaggttagatgtagtcataagggtgggatactgtactgacagaagggaaacctctaggtatccaggtttaaaaataaaaaaataagacttaaacaaaatgagtagaaacattagtagctacacactacaagagagacagaccctacagaatgaatctgggcagaaactgtagctgctataatacagtaccaaaaatgtccacttctaaaaaacaattataagacatgaagaaactgacttgtacacaggaaataaagcattaaatgaaaactatccctgaaggagctgagatattagacttagaagacaaaaatgtcaaaccaacttttatacatatattcaaaactaaggaaacatatttaaagattaaatgaaaagtactaagacaatgagttgtcaaatagagaataaagatacagaaaatgaaaaaattctggagtacaaaagtacaataactaaaatggaaaaatttcactagagaggcttaaaagcagattggaactagcaaagaaagaatccatgaagtcgaaggtaaatctctagagaaaactgaatggagactcacagaccagtggaatacatcaagcacaccaaccaatatatgaataattggagtcctagaatgagaggagtgagaaagaagggaagaaaaggtttttgaagaaacaatgtgtgaaaacctcccaaatttaatgaaaaacagtctcacctaacctgatcaaccaaatcccattttcaaaaacacacagatatggctgggcatggtggctcatgcctgtaatcccagcactttgggaggccgaggaaggcagatcacctgaggtcaggagtttgaaaccagcctggccaacatggcaaaaccccgtctctactaaaaatacaaaaattagccaggcgtagtggcgggcacctataatcccagctattcgggagcctgaggcacgagaatcgcttaaacccgggagccagagattgcagtgagccgagatcatgccactgcactccaccctaggcgacagagcaagactctgtccaaaaaaaaaaaaaaaaaaaaaacaccacacatatacacacagatctatccctagacatgccatagttgaatttttgaaaaagacagaaatgattcaacacagaagggaaccacattaagaacataaaccaacttctcatctgaaacaatggaggccagaaagcagttgggatattcaaagtgctgaaaggggggaaaagtttatcaaccaagaatattgtataagcaaaactatcatttaaaagtgaaggcaaaataatgacactccccaataaatgaaggctgttagaaatcattgctaaaaatcttgccttgtaaaaaaatctaagggttcttctatctgaaagaaaataatagcacacagtaactagaatacacaaagagctaaagaccacggggaaatataaaatgctgtataaatatttttttctattttcttaactgtcacaagctaggcatacttcccattttataatgtacaagtggtagaattttaccatcttttggcgtcaaaaggcagactgtgagtgaaaataggacaatattaatgaccaaccaagtatcctgtccatcaaatacttaatcctaagtggctctgctgtcagatccataaaagtgaaaacacatttaagcagaagcatgtaaagagctagttttaaaatgtaggttgtcctttctttagatttttatacttgagcctcaaagggggttatttggtttcataaaattaaaaacatgtcatctgtattccttccttccttctgcaaatatgtattgagcatattgtttgccaggaaggtgcctgtcattctgctctgtagtagtaaaaaggcagtggcaattaagagtttggagttgcctcatttaaaggctccctaggaaacatgtgacgaaaacaaaagtgattctgtacgtgcagtgagcaatacacccaaaagggcagccagaaatgccagggaaaagggagcaagaaaattataaaaacggcttgtgagaaaaatagcagaagaaactcagggaacaaatttgttagaaactttttgctttgtggtttatttcacaacttgccatctaatttcactccacgtacttaaccatccatgcttgtctccagcatcgcactaccagtcctttcaatgtgttctattcaggacttcttacctgtacctgaatgcctcccagacaccttctctctacaagttttcaagctactttggtgagtctagggtgagagtaagcaactaattcagtcctgaatccctaagactggtttagaagctctgcccactcccatgaaagttccctcaacaaacaaaaacaattgccattcagtcaacatttataggtataattaggtaatggggaattttgtttaacactattagtaccaccagcccaagacagcaaaaagttcacaactttggaaaagaacttgagttctggacaaggctcaatgtcttattaattgggggccataagtcccacaggtaaatcttgggttgtatctgttgttagattccccactggttggtgcctgtcaaaagtatcctgcttgggcaacaaatgttatcattatcctacttcttaaccatataacctttggaaagctacttaacctctctgcaatgttttctattttctattctgaaaatgaatgtggtaataatatccaacttgaagagatattgcaagaattaaataggacagcttatgtaaaatgcacttagcaacttaatggtctatataattattagtttctcttggttgcaatgacttggaagcattttaggatcttggagcatcttagagccactgccatgaaaaactgttattcttgctctgctttaggtaaatggttcaaccagtctttattgtattcgaatcatctatcttttcacttttaattattttaactgggccctatccccgtaccccttttccctaggtagaagtttaatgtagttccaatcctcatttttaactcaatactttactagggaaggcacaactgtgtacattaaaccatatgaagatttgaatcaacacagagctattcaactctttcttctactaataaaacatcatcattaaatcttaatttagtatggcttataagaatataacggatatatcaagctatatctttgatgaggaaatgtttgttgacaaaatttatctataaatgaccacatcatttctgttattagatggcattccataaatgttctctaagaacgctgtttaatcattgaagagggtaaatgtgaagaacaaaacagagtgtggataaaagccaaaaagcacgggtaaagtcagttaagttgtcctcatttattttcttgatgtttatatttctcaaagaaatacatgtgcattgttttaaaagtcaagagctcttcaaaataatagcaggctcctacccccacctattcccacccgtgtatcaactcctttgaggcaaaaaattaaaacacttttatctgtgtatttttctagcaacttatctccatattttaaaaatgacatcctaatacaactatttctttatttgttcatttaggcattatctgttaatctgctaacatggaagatgaaactttagcttttttatgatctctccatacatatttctcctttcttacctacccaaaataatagtatcacattatttgactaaatcaatattcattgagcaatatcatgtgcaattagtcctacttttgtctcctttttctccctttggtattaatactcagccgtgatcctggactgtccttttaccaccaccctggaagttccctgtggccccactggtattggggcctcaggttttgtgatcccatattttccaatgttttggttcattccctctttttgacaaactacaaaaagggtatctttttggagaccctgcatatctaaagatatgttttctactttcacactttgattgataactttggctgctatggaattctagttaagaattttctctatgaattttggagaccttgcttcattgtcttttaaatttctaagttgctatgaaaagtccaatgcgaatccttgtatggaaccaggtttttttttttttttttttttctgtttggaagtttttaggatctcttctttattgtttttccattgaatatgctggtgggtctcttaaatctggcaactcatgtatttcacttataaaaaatattcttgctttttttcataattttcctctttcactttgctctcttttaattgggaccgaccactagacagaggttagacatttctaattaatcttttctcttattatcaatctcattgtcttttggttgaactttcagagacatttattcaacttaatattctcatttttgcatttaattattttaatttctgctatcatattttttaatttctaagagttcttttctgttctctcaatattcctttcaataatatcctgctttcatttcagacatgcgattactttcctctctgacaatattaattatagacttgggcatttgggaaattttcttatgcagtatcatctgtttcctccaagattggctttcctatttgtatattttgttaccatcactgccttttaaatcagacacgttcctcaaatgtcttttgaatgacagttcctatttaacagtttcaccctaaaaagctcactggcaattctgggtatgggaaagggctagctagttgatgggctttcagcagagggcgatgagacagtgtacctgcatttacgctgggatggagtactcctccaaatgtcagtatctgtcgttctttttcttgaatgtatctgacaaccatatatcctccttcaaccaactgcttgttggaggcagtggctgtcaatgttctggatgtggatttcaggaagaggttaactaaatgtgtgtgcaggagggaggcgcccacaattcagcatgtaaactttcaggtcattctgctttcagtgaagtaccacatctctgcccttgactgtaccttgggcctcaaagctgagtttctctaattcaatctgtcaaaaaagtgaatctcagggcttctactaaggtgtggagggcccaggtggaggaactgcaggtttccctatcaaaccttctcagatgcttctttatcagctctttgagtccatccccctatgtccatatgctttgcttctaacaactctcacttgcaggcttctttagagccctacttttgggctacaagtacaacttcagcagcatgccaagagagtctgtagtacctgaaaatgtacataccccccccaccaccagctgaagctcattacttcaggtacacaaaagtgtacctctagcctagagtgtaatatacactccaaagcttccctacaagatgagacagaggctggaatttagcctaagatcccactcttgcttcatttccttccattcactgcttcctactttccccattctcatactggtttctccttggaacacctccttaataaacaattccatatgaatccacatctcaggttcaacttttgggaaatctggcctaagaccatcatctggttgctcagatttgggaaagtatctgggagtctaaccactgtttatcaaacttgcaactaattctgttttcatacatgacccacacccccactaccaccagagacacctggaacctccaattcctgaacctttctactgttcaggaggctgagacttccaggcttctggaagtttgtggaaaatgtagagcaccttcatgtattgtcattttaaatagaaactttagaaacattttgcatttgatagagttgagttcaggctattcttccaaacatcttggggtgcaagcccaagatcctcttggaagtgtgtgctttagtagaaaaacatgcagacagattacctgacttaaatctatagaaattaagaagttatatagtcagacaaacgtgggttctactactttactagctgtgtgatgataggcaagttactaaacctctctaagtcacaattttctcacctgtaaaatgaagaaaatatgcttatcacagtgcctgtcacatagtaagtcttatcctttgatttattttctggtggtgataagtttatggtactgccgccatataccctcacctagttcccacatttcagagatgtttggccaaggttaagggtatagtctaagaaattcattctcgaaatgtattccccagaccagcaacagctgcagcatcactgggaacttgttaaaagtgaaaattctcaggtccatctccagaaacttggggagtggagcccagccatgtgtattttaacaagccgtcaagggattcaaatgtattgcaggtgtaagaaacacttgcatcagaaaaaataaataaataaataacagacccacacggagaataaagccaagacttagaacccagttggtgtggtatcaaagatcataagcagagctaatcaatatacatgacacccccacccctgattagggataggggaaagtcataattatagctttattattaaagtagcatagttgttaatataaagagcattatgtgataaatgaatataaataggagctaggaatgaaagagtgaagtgcagatttaagtttgtaaaactgacagtgagtctatgccacgtagctttcaaatactaatagagaagtgcattaatgcatgaaaaaaataatttctgagcccagaagctgaagaaacacttgaaagaatccttaactgtattaatcctttttgaaacaagccactatatgtacatgatctggaacatttgctgaggaaaacttattttaagttgtcactttgacagtgtcacaactattgaaattcctctgaaattctgaattagtgctatgtaagcaaattatctctagaaacaaagaagagaacctaagagcaaaatatagctcactgaatccaccactcagaatagggagttggagtggggaacagagcaagcagcaaatattccaacatcacctgcatggcaatttatagtatcttcaagccaatcaggtgatttactccaaggagcacaaatcagagagacaggaaagccaattcttataacactgcaaagatcctacagtttttaaaagagaaaagagccctttccctggaggaagtgcagagtaattcatacaagttcttgttttaggggtgatgcccactcaatttactttgacatataatctgcctgagcagctcagcttaatctcctgcatggcagagcagagggcttccctccagccctttaaggcctctgtgtgaaaatctcaaagctttgctgttgccatccaggacatagcagctctgaatgccaccacagggaatataagacagattggctgaacatccaaaagaatacatatgctatttagtcaatgtagagtgctttagcaccctacgctaaagcacaccaatactcagaatcaatatccagaacactggcagccactgtcttcaccaagcagtaggttgaaggagggtttatagttgtcagatagattcaagaaaaaagaatcacagatactgacatttggtggagtactccatctcagtgtaaatgcagttacactgtctcatcaccctatgctgaagcccaccaatactcaaaatcatggctgacagagggaattcgtagtctatgcctgggagcatcctctgccaagcatgttaccacacattctcagtggcccttcctagcacacctatgaggtaggtgctgcttgaattgcattttgttggtgaagaaattaagcctcagggatgctaagtaacttgcttaaagtcaaccagatattgcagtggagtccaacaatcccaaggctacctgaatctgaaaaggctgttcttaaccatcatgctttaatgtcttcattgagagtccagcctatttcaacaattgcaatttgtaataaatatgcaattctctttgcttcacaagaaaaaaaaatttaaaaagcaagattatgttaatgatatatgcataaggacaatatattgtttctggttggacactggatctctttagcctcggatagctgtaaagtctgtcagaaatgtgtcttcttcctaaactcattgtgtaaacagagattcagctggtcccgacagtgcttgctttgagattggtgatgcttttgttgccatagacaccagatttcaacacaccactgagcatggggaatccattccgcacaaagcaatgcagtcagcagatgggcaccgtaacagctaactgcacataatgccataaccaatatttgttttgccacctctcatttagatgatgttctcaccaatgaagtctgtaagactttgtctctcatctgaaaaaccgcttctttatgacccagatagccatactcacacattaacgggccgaagtcgttcatttctctggtttggtgaatggttaaggctattcagaaaggaaaatctgattttacacaaaacactcctttattcatcttgcaaaaagaaagatcaaatacttcttgaaaattcagtttgttcaagtggctagcaccccaagaataatgggcctgttatcttggtaggtttccctagtaactaaaaccataaagaaaataattaggaagagtttagtgacgtgtgcatgtgtgtgtatcttatatccacatgcatacatatatctgtgtgcgtgtgtgtgtataatgaggacaacttttttttatgagacaaaccaaacaatcaagacatggtacttgactggtggtcagagatgaacttgtaaagttgaatcatgaaaagaaagacttggacacatcatgaactgttggaccagtttacctagagaccatgaccatgtgaggatactacaggaccgtcctgtcacttgaaggaaatccattgtatattgtgttgcagccaatcacatgataaacatcatttaccaaattaaccagcaaaagtgtaattagagaagttagtaagaaatttatataatctgtcattttcacattcaaaggccaatacattttaaaaaattccattaaaacaatctccttatagagcactgggagtttaactattggcaaaataaataattaagttcatttaaaagaatttttactatgtttatttttccatttgctctaataaaaattatgaactatgttctctttaaatataatacaaataagtttgggttttagtggaatgtatattaacagatgaaaagatataaataaaatgtatctaaagctttttggattattttgagtaggtctgttaaatcattgtgattagaaaatcaagaagaaaatgatcatttttaatttaaattaatttagagttggaagagaaactgctttatgtgatgcaggtaaaaatcaattgaatgactaaaataggagtggtatcatgattatcaggctcatgttttctgtttgggaatgatgtaataaagtgtctcttgaattatgatgaaataatttaaaactgctgggatgtggtttgtttgggcctttaaaggaattctaaaaacttgctgtatacagtgaaaaattacatctattaggaaaaagaaatccatgcatttgctcattcattcaatggatgtcagcagattccttaaacctgcaaggagatggaccaggaagtgactctttccttcagtataacctacaaaccagagagctggtattcttgcacctatggaagaagtcatcttcagtacaagaaaaaatgatgaaaattatgatgtttgtggactcggttacatttgttaacaggcaaccccacaaaattggggaaaaattgtaattcagagtgttgtgctcaagtttgctctgtaaaccagcaagagcagcatcacctgaagctcagtagagatgcagaatcctggggtacactccaaacccactgagctaaaagctgatttttaacaagatccatggggtttgtatgcacactaaaatatgaggatcaccaactgaaatcacagatttggcaaccagcctggggaagatggaaccccatctctgccactgacttgctgtgtgatttggaacaagtttctcaacctctccgtgcctcagtttccctactggatatgatggcgataataatggtgcctatgttataaggttattggtagtattaagtgacatatatgtagaatctaaaaacgtctaactcatagaaggtgagagtagaatggtaattgccagaagatggaggtggttgggggaagatgggcagggaaagggtagaagttggtaaaagggtacaaagtttcagttacacaggaggaataagttccaatgatttactgcacagcaaggtgactatagttaataataatgtattctatatttcaaagttgctaaaagtggattttaaatgttctcaccacagagaaatgataagtatgccaggtgatggatacattaattagcctgatttgctcattccacaatgtacacatctatcaaaacatcacactgtatcccataaatatatacaattattgtcaattacaaataataaaattttaacaaaattacacttagctacattttgaaaagtggcataatacatgaaaaatgcctacaacagtgtgtggaaataagtgatcaatcattgtcagttcgtattacatcattttatcattcactgggttctgggtcatggataacaaagggtctaagctgtagcccatagacgtgcctgctttctggtagatctgtaatcaggcaattaggaattgaacccagcctacaaaaatccagcttgcccaatcctgctgccatttcaagccaaacttcagggtttacttaggcagtatgcaacacacacctgcctgaaaaatggggaccgctcaaatccaaagattgaatgaaatcctacacatgcattttgtttggtaaaagttgaaaggaataataaggacactcagtttctatcctggaaacctccatcctaattttctgctcatcagtttggcatatattaaaaactctgaagaaacccagtgagaacacaggcactcccaaatgctggtggagagaatagaaattgatggaacatttttggagagcaatttgataatcctctatcaaataaaaaatacatgtaaactttgacccatcaattgtgttttaaaaatttatcctacatagatacttgcaaaagcaggcaaaaatacaaatatagaaagacatatatatgtgtgtatacacacatatatattacatgtacgcattttactctgtaaaccacctgccccttcgtcacttagtaggagtctctaggcgtcttgggtatcaaatcgaaaaagcagtatatatagcgtttgttactatccacggtttcaggcatccactgggggccttggaacacatccctggcagatacagggagactactgtatatgtatatgcatgtatattatttatggcactatttatttgtgatagcaaaaaagaagaaatgagtcaacctaaatgtccatcaataagggttaaattatagtataaccattaaatggaatgagtataaagaatgttacatctctatacaatatgcaaagatgtccaatgtacattaagcaagaaagtaagctgtataatatatgtataatatgataatttgtataagtggataaaatataggtattttatggaatagacttctaaaaaaagaaaaaagttaacttttaaaataaattttaaataaacaatttaaagactcattttgttttagatctttgtgagagaaataatttttaagaaaaactaggaaaaaagcagttgctgccataaagtatattccccaaactttactagtttaaatcttaattaatagttaatatcttagctttcatttaattggcagctagctgacagcaaaaacaagataccttacaggtgtcatgacgcatggaggtgacctggaaaagggaagagaaacaccaaaggaaggaaaagcgaatggataaaggaggtcacaagacagaccttgccaagggatgccaaagggcagatgctttggtaacaacccaatagccatttccttcttccttttttcatatcagaacctgtgtccaatgatagaggttaaaaataaaaacactagccttcccagcctccctgaaactagaactgactaatgaccaagtgctgggcaatgagtcagagggaaattcttctaggatagagtgttctacatgacattagaaaaagatgcaggggaaaaaagcctcagactttccctcactacttcagttaggggaacacgattagtgtacgattagtacttcagttaggggaacaatgaattacagcagccatcttacaacattgaaaggtgaaacagctcaaacactgagaatagcagagaaaacgcctggaaagagcttggatttggataactctcctgagttgctgaaacaatcctggagtggcctagttttctactccttgctaagtgaggtaataaatgttctcattatttagatgactttttattgggcattttgttatttacagctaaaagcattgccccttatacagctgccaaccacctgccttagaaatgagccaaagacccaattaacaactttgcaataatttgttgttgttgttgttttcaaatcacagcaggaagatagatacgtcatattaagtatcattttctatctgatattcagaattaccttaggttttctgttagtagtagcgaaaaaggctaccattgattccatttagcagctactatgtgccaagcactgtgctaggtactttgtctaggactggtcatcacagcaacttccaaaccagtctcctttggctggggaaataaaatcacatctacatgtttcccagcttacttaaacaatttagcatttcgttacaaatgtaaactacaaaccactagttgtacttgtgactttgtcacctacagaaatcacagatgcataccacagtgtagctgtggagggtatctcaaaatatcattgactctcatcactgtttcaaaagtatcatcatcctttagcctgctgtaaaatcttatttaatgtgttgataaaggagcacatacgctactgctcacacattttaaaaatgttttggtaacggcgttgcaatataattgacttcctttgtaattctgtgtgttttattttatgcatttaaaaatattattctaagaagaggccttggcacaaaaggggtttaaaccccccacaaccagtcccccttgttatcattcttaatattgtcaatccactcttaatacagaaaaccagggcgatctttctaaaaggtaagtcagatcaagatttttcctcctttaaacacgaaacaaatgcggactcctaactttgactaacttgggcctccaggatctaattttaccctgctcatgtctccttccatggtttcaaacttctctatcccctgctctctctctgctccagccatgctagcctccttctatttctttgaaatatccaagtcatttcctaccttaggggctcttgccctctgcctggaatgcctgttcttagagcagccacttggttcccatgctctagtgataagccaggacgctgcctccacagagaagctttcctaccaaacagcagccctcccctttcccacctgtcctcagttagttcctgattacatccttaagagcacttacctaaaatgattgatgttattttttttcttcaccaacagagttatatttttgttcactactgaacccaagaatctagtaagttgcctcacaccgtgtagaaacctgacatttactgaatgaatgaatgaaaaccagaacaagtcaacaaagaagctcttattaatcaatttacaggtgaggaaattgaggctcaacgatattaaaatatttttcccactttgggaggccgcggtgggtggatcacgaggtcaggagatcgagaccagcctggctaacaccatgaaaccccgtttctactaaaaatacaaaaaattagccgggcacggtggcaggggcctgtagtcccagctacttgggaggctgaggcaggagaatggcgtgaacccgggaggcggagcttgcagtgagcccagatagtgcgcactgcactccagcctgggggaaagaacaagactctgtccaagatcactcagtggcagaattattattttaactgagatcctaggtctcccccgaatccctctgccattgtctgctacatttcccccagtcagtggaaagccgaatggacccaatataagtttttatggcatgatttcttgagacttcaatgccccattgcttaaggatatctgcctaagaaatccttggagctactccaggaaggccaagttaagtgaaaatacatgcctggagagagggattctctgtctcttgccacatacacatacatctttttcttatatctgaaccttgtaaacataaatacaaacaacaaaatcaaataaaaagaaaagaacctagaaaagggtaaactaaggaagaaacaaattagataaacccaggggaaatgtctacacataaatatagatctgctaaggtactgtacgctagcttatatggaccacaattctagccatacactccctagtagccaacacaaagtgagaaacagaatcagttacatgacatattttgaagatttttaaaattcaattgccaggagtcacacaactattactgtctctacaatctgagagcaattcctcttgtgggtctttagagtgaaaggtaggatatagtaatcagcattctaaactatagaccttttaaataaacatatcaagcttcatagaatggtgtcttatagtatgccttaatagaggtggcaggtataatgccaaaacctatgcagcacagtattgccttgctattcaaagcatgctctatggacccgcaacatcaggatcacccaggaacttgcagctctacaagatctgcgggtgattcctaagcacattaaagtttaagaagcactgctttattggttgagcttaagccatgaaaaataattggaagaaactacaattcattcattcattcatttaacaaatatttactgaaactttggcagtaggaaaggatttctttaaacatgacaccaaaactaccaccgtaaaggaaaatattgataaatgggacaccactaaaattgagtgatatttgcaaacacacacaaagctgggcatctaaaaatgtgtcaggcagtcttggcaatgaacatcaatgaaaccaaaaatgcctacccttatggagcttacattctaatcagcgaagacataaataaacaatttaagtaaaacaaatcacgaaagggggtaagttgagggtggggttgcaattttaaatagggtagtcaggaaaagcctcattgaggaagtaaagacctatacaaggccaggcacagtggctcatgactgtcatcccagaactttaggagactgaggcgggcagatcacttgagcccaggagttccagaacagcataggcaacatggtgaaactctgtctctacaaaaaatacaaaaaattagctgggtgtggtggcgcatgcctgtggtgtcacctacttgggaggctgaggtaggaggatcacctgagcccaggaggtcgaggctacagtgagccatggttgcaccactgcactccagcctggatgacagagtgagaccctgtctcaaaaaatatatatatatagatcaggtgcggtggctcatgcctgtaatcccagcactttgggaggctgaggcgggtggatcacctgaggtcaggagttcgtgagcagcctggccaacatggtgaaaccccatctctaccgaaaataaaaaagattagctgggcgtggtggcacacgcctgtgatcccagctacttgggaggctgaggcaggagaatcgcttaaacctgggaggcggaggttgcagtgagccaagatcatgccattgcactccagcttgggcaacaagagcgaaactccatctcaaaaaaaaaaaaaaatatatatatatatatatacctatacaaggtcagagatctagctataaatatctagggggagtgttccaagtagaaataactataagaacaaacacactgaggcaggaaagtaactaaaacaggaagatggccagtgtggttgaagaagaatgagcaaagagtagagtaggagtgtaggagtgtaggaggctagatcacgtggggccttctcagctatttttaagaatcataactttaactgtgagatgacaagccactggagaaaaagtaatagggagccactgcagtatgttgagcagggaaataacatgatgaaaagtgtcttttgaaatacttgtttcttagaggtagacggaacggcttgagtgggagattctagctcaaagtatattgcaccaatcccaatatatggtgattcattcattcaactacttattaggtggcaaagatgtgcccagtaatgtggggaggatctaaattagagcgataactgagggaattgccagaggaatgtgaatataaatgacatcggaggggaagaaacccaggacatactgacagattatttatagagaaatgacacaaattcgcaattcaatctaatcaaggtttatggatcacctactgagggcaaagccatgtgctggctatgacttgcggggtggggatggtgtataaaacttgtactttcccctcaaagggcttccagcctggcgtgcttagcccctgccctacacttttcaagccagaaagtcttgaattcccacagctgcagctggcactggaactaactggtttgctcaggttaagagatggctgttgtttttgttgttgttgttgttattcttgaagcttgttccatctcctgggagcaggggccaaaacacctcaacttgattagtacaaaaaatatagatctggtttggcaggagggcagaagagaggtcttaataaatgtctttgtggatcagtgttgcagattggcctgaaccaccagtttttgggcagagtccttctggtctgcttccacctctgtgacgtagtggtcacacactcttcccattccattctggagaaaaggcctcaaggcatggaaaagggaagaggcaagattaaggaaaacaattggaaaaaaatttttgaaaacctcctgctgccagactacaaggtgaggggagcagacacgaatgcaacgcaaatgatatgtaaatatctctgtggccttctaaaaggttttctacaactggaatggcatttgaaaaactgctggcagtaagagtgactcagaagcagagcaaactatttcaagacaactttgtgacataaacctttgctgcccagctaacacagtgcacattctttagtaatctttttctcacttgaatcaacctcacctgctataaataaaaaaaattaaaaaagcggtcctcagctccgcactagggggcacgggtaacagcatggacaccaagcgctgcttcgccaagtgcttcgatgactaccaaggcagcctgctggcgggccagtgtgaggaggcaatggtgtccttggtcacttgcctctgcagaggttatctaagttaattattcttttaaaacactctacatacctttaatttttcttcaaacgcctttctcacctaaataaagccaagttaaatgtgtcacttcctccctagaacagtagttggctccagtggattatgaatgaaagtgcttctctctccattctagtcactatgatccttcagagttttgttctttttcctattccacaggaactggcatattctcttctaataaccacatgctgatttcaaagtgagtccaggaaaaaatatgtatgtgaaaaccaattcacttttaggagccactgtaaagttattcatcaagaaaagctgccctgtcaagaaagctgtggtcttgcccatcctaagcaaatatgtttaagtgaaataatgcacattcaactacaatggggtacatttccgggtacgtttccgtctacatttatgtatttttaaaggggacactcctatcagatatgcatttaataagagccatgggttgaactgaatagtaagcaagacagtaaacacatcagacccacagctgagcagttatttttggttacagacccaggactccagaagcaacttacctccacatcggccccgaaaagttccattactttctagcactcttaacattcgagggtgcctcagcttttgacagcagagtcaaaggaaaggaaatcccttccatttctgaagttttcatcttacttgaaagggccacactgttatcccccagaaagctaacaggcatccggggtgatgccacgttcagagtaaaaacaggaacgaagcgcagagacgccgaatctcaactaatgagagactgaaaaaggaaagaagacggacaaaagcaagagacagacctcaagagactgaagaaatgctagcaccacaacaagagtaacaaaaacatggagagcaaccgcacagtgctgcccgagccacggagtccggaagggaggccgggcaggcggcgagcgccctcccgcggcccgggctacctcttacctcctggacgagtttctgcttgagcaccagcgcggcacacaggtaacccgcgcggcccacagacagctcgtcggagccgcactccaggaaggagaccggcgcgcagacggcacacagagcccggaacttgcccagcggctgcacgtagtcggaccggcccagggcgtggtatacgagcgtggccacggcgtacacgcccgcgcccccgagcaggaaggcggcgcgggtgtcggcgtccggttcgccccactcctcagcgcgggcgcacgcgtccatgaggcgcatagctgagcgcaggtagcgttcccgggccgtggcgaaaagcgggctctgcgagacgtggtagagcatatacgccactccggccacgtcgccataaaccccccctggcagccgctagccctggccgtcgcccctcaggcctcggcgccgccccgagtgggggaagctcctggaggatgcgctggatggtggcggtgaccaaggacgccaccgcctcctcgcactggcccgccagcaggctgccctggtagtcatcgaagcgattggcgaagcagcgcttggtgtccatgctgttgcccgtgccccctagtgcggagctgaggaccgcttgaagttgtgccctgcagccccgcacaccacctccggctctctgaggcactcggatggcggtgtatgcggcggggaaggagcgagaaggatgagacgggaggtgacaagaggaggcgggcaaggagcggatggccaagtggggcgccgggttgctgcgaggctcccgagtggcccgggcgatcgcgggggatgcgtgtcgtgcgccccccctctgaggccgcgccctcgccgaacccgccccctcctgcgccgccgcagcttggctgcctctccaaggggccgaggtgatctctggcaggacccacgggggacccgcgccactcctcccgctccgcccccggctcctcccctcctgacggaaggcctgggacctgcgggacactgatctgggacgctgggactcagcatacacacacctggcggtagaggtgatggtctccggtcccttgtatactcaaagtgtggtccttgggttagaagcatcagcatcacccgggggcatgttaaaaacgcagcatctcaggcttcactccagacctattgactccaaatctgaatattcagcaagattgccaggtgattcgcatgcacattaaagtttgaggcgccactgaactaggctagagtagcaagacaaaactgggcgccttctttgaagtttgtatttcatcttggtcgcttcggagttctcattatgaatgtttcaatcccaaaggctggggcatttgagcacatcatgtttaatgcattaaaacggtgaaataccccatacaggaacttttttcccagctttgatttttgtattgttttcttcgagtatacaggagtaaaaagtcaaagaaccacaccaggttaaggcaaggaaggggcacgcccctcctgccatgcgtgcatagtaaaagctcaatacatatcttgaggtcattaactagttaatattaggataaacgctctgtgagaatttaattaggctttttatctcccccttccgtcccttcttttcccatgtttgtcctcttctgcttttttcccaagggcgttgtggagggtctcctatgtgtcctgaaacctggaaatagatggatgaataagatagacatggtcctagaccccttgtagcttacaattcagtaggaaaaaacagaaaatgaacaattacacaagctagttgcctttcttgtgctcagctgtttgaaataattctgcctttcccaaagtgttgactcttgaagactaaagaggtcacgtctcccaggagtatttgacttttgatagggactgtgcaagacataaaggagtaagtggctcatagaacagtttctgatactttgtggggagagtaactactccacttacttgaaaggccagtttggaggcatttttttttcctcagaagtgttaaatgtcaccatgattgggaagcagatattaaataccctgcccctccacccttacttgatgtagtctgggaaagaaccttagtttgccaacatgattgccaggactgacacatccacatagttcaaggacagtatggccatcgtccccctttgatgctgccaaaacaggtttatttttaataataataataatgataaaagtccacttttaggcagggagcttgatatgttaaaggaggaaaaggcatcaaagaagcaacaggaatgttgagtttctccttgagacttccttcctcatccctcaaccataacagacattagaggtgatttttgtcccctcagacaaggaaacataaaataaagcctttaccagcagaaatgaagccttattccacttcattcctccacacctcactcacccttgtcatgaatctagaggcaactctattaattctgactctgattattcttcgaaacactccagcctagaggtagcaccagcaacaacaacagggatctgctaactggcttcaaaatagaactgtgtgtaaacacgtctccaagaaaacgagctcttccactttttcccagttgtgtcatctgtctattgccccaaaatgctgtatgaaaagcaatcacaaaatctaatagcatatggcagtaaatttaatgtttatgcatctaggatcttggctgggctcattcaggtgtctggaggttggttgggtcttgcttggggagactgaggtgactggcctctggcccatatgtctcttctcttttagctggccaaccccagcatgcttgcacggcaatggcagaggggctaaagcaaaagcagagacatgcaagacttctgagggtctagtctcaggaccacacactcttttctgccttagtctattggcaaatcacatgaggaaatataaggtgtttttgttgaacttcaaatttgcatgacaaagggtatggatacagggtagggtgaagcgttagggttctttgaaaccccacctctaattgtcctatacttaatttgcatgcagtgttatttattttaatatcactactccactagaatatactctccatgagggtagggctttttcttgcatttatttactgatatgcaagatcctagaatagtctctattctaccactactactgctactgctattgctactactaccactactccctgtagtagatatttactgaaagtttatgaaataatgaatgaattaccatgagagtgccatgagagacttaaggtaccctaaagtatagaacacagagtgaggccttttttgaaaccttagcctgacatgtctaatctcctcctatattcttggacccttttcctcttgtgagcacaagaatgtaaacattctgcagtttttgctcttgtctgtttctctacaagatatggtgacctctatactttaccttgaattcagggccttcacacattctacttttgctaactaaccctgtgcttatatttttcaaatatggccacgacaatatctcctatgccacatgttcctctacaatccatgtgaccttgacattcctctcatcaggaggcaggtacatgtaacctcttctgaattctgggtgggctgatacttcatttgtaacaaatagaatgtgatggaaataacactgtatggcatccaaggctaaattacaaaaagtaatgcagcttccatcttaaatgttgcagcactcacatttggcaccttgggctgccttgtaagaatctgactaccctgaagctgccttatcgggaggaagcccagacaacatgaagaggtcacctggaagtgcttggattgacaacccgaggacagcatcaactgacagctatgtgagtgaaccactttagaaatatccaccccagtcaagccttcagattaccgccatcccagacccttccagaattcctgacccaaaaaattacaaacaaaaatatagttgttataagcctcgaagttttaggataatgtgttatggagcaaggtaactggaatgtcctgctagcttcccataatccaatgctctggaagtcccctctaatcaacagtctacactcaacagggcaatgagcagttaggaagataaatattttagagaactctggaagacagagaagtatgcaggcacccaaaacattgtgttctgaaataacaattccagttggattctttaaaagtagtgatgaccccacaagaaatatgcagtctatacaaaatcttgccaaggccatttattttaccattatctgcaagatttgtcctgatagtcacagaatttctagcagcatttgctgacaggcagctcccaacacatgtttctgtgatcttgctgaattgctcagttcccagttcttctcagtatgtccttattatgcagattatgcaaaactatggatggaagagagtattattgggttcatcaaggaaatcgcataaaaattatgcaacactatccagaaaagagagtattaaaatcagggtttctcttatgcaaattattgctctctatgggtgaatatgaaaaaaatcagtaattgtataactgtcaaaccttaccaattaaggtttaatacattttatgggataatgcatcttagaaatgctttcaaaaggttttccaaagttttgctcaaagggtgcatcctagaaatgcttgagataactgaatagtgctttgttcattccttatagcatatcctctgtggagactcatccctattttattagattaacaacataattggaaacttttccctaattctgctctttcctttgcagttttctctccttggaatactcttcaaaaaattacctcatggcttgccttttcaccactctctcaatgaggttttctccaacttattattttaaagttactgcccttctgccaatcattagtatctaacaactatatattttacttacttattttgtttcccatctatctctctccactaaaatttaatccccataagaacaggaaattttgtctgtgttgtttcctcttgtatcctcagcatctagatcaatgcctgacacatgatatatactcagtagatacttattgatgtctgtgatgctcttcataatgtcaaaattttctatcaatccatggctgagttttgctgtctgctttcctgaccagttgcttgattatacacctctgccacaagcagccacaaaaatgtgcattctaacataggattttattctctttattgtcttttttccttctacttccagttttatcaatttatagtactttgttagccattataggctaatcatgattgccaatacacgtgtaatcccagaattaaaagccacctgaaatgagcaagcaaagtggtacttgccactccatctgaaggaggggcagccgagtttgattgggtcacattggccaagaacaagcaatggtgcacaccccagcttattggatgtgaagaaagtataggtcaattataccttttggtattacaatgtgtgtgtatggatgagtgatttgaatgaaatataataaaacattgctgtatgggacactgctaaaacaagtattcctcccttgtaaactaatgcatctgtgtaagatacattaaattggcaagtggggatataggtgttcctttaggtagagtaaattatttaactggaaatgtttaacagcttcctacatgtggtcatttctaaggttttcgccagcagtcagaagggtaggaggaaaagagtgattataaattcctatggtggtatagttcaatggctattaaataacctaataatagcttagtgttgataatgcattaacacatctgctttttgtcttatggtacactaacatttttcacttgtacattcacagttctccttatcttaagaagttccaatgtcaaaaacatatggtagaagtaattctcgtatacaatttttagacatctgcatgaatgcaagaggtggtagttaaaagagcagatatcttccaaataattcatattgattttgactctggaacggccatggtcgcacttagccagctgttctcaatctgagatgactgcttaacaggacttgacccagcattctcatgagatacagtaaggggcgataaccagaaaaacacagggtctcagtccataatccaaaaggtagacaaaccaattaccaaatgattaaacagagctaactactttgggctggcaaggattaacagaatcatggagctggaagtcatctccaagagatcatctctttatgcctttcctttaacaataaggaaaccaaggtccatggaaatcatacaacaggcaatccctgaaaggttctgaagaggagagtcgtgggatcatatctgtgctttagaatgatgagttttcttgaaaattagagaacgtatttgaaaggaggacgatatgtcagagcagtaagtagaataatcaagaaacgaggaaatctgtactagggcaataacaggaagggtggcgagacttggaagaagtcaagagatctgaagcgagcaggtttacagggttttatgagcaactggatgtgggagtaaaggaggataaaagtcaaagattatggctggtttctgctctggacaattgggccaacaaaggtactatccaccgtgccaaagaatatatgcagtggaatatctattccactttatggggcataaagatgaaggaaaatagctaattcagttttaaaacttgagtgtggctttacagtctcatgatgtaaaaagagaaacaataaggcaataaactgttaacaatatgtcccgaagattaaaaattcagtacaactgattaaagaaggttgatagaggtgagctttggaaattggttaatatagggatagtacagagaaaggcatgtagctgaacttcagaatgaggaagcttgaccacccagcattcattgccttctactatcagcaacatcttgagtttattttgagaaaccaccattccctgtttctggaacatgtgatttaaaagaaactataccatttccatgtccccaagggggagcatatatcccaggtctgcccaaggagaagcaatcctgagctttcttggctaaaaccattgggaaagctaagattcctaatgtagaaggattaaacctacagctactgctggctctcttatgactgcaaggtgaaagcatgctgaggattaaaccacacagaggaaagcagaactgagtaataaaaaaagtatgacatgctataacaagatgtcttagaataaaaaagaaaaaataataaaccaataaaacaaaaattataataaaaaaggaaaaaagtatgacaaaaagtgtgacccaatgacattattaaaatgcctgcatctggccttccctgaaagactattcaattatggaacccagtacattccttcttttacttaaatgggggtctgtcacttgcaaaagaaggagacctggaataattcagcgttatttaaccttcctaagccttggttctctcatctgtaaattggtaaagacaatggaatctttctcgaaggttggttaggataatgcctataaagggattaacttgatgtctagctctgaataaatgttaacatttgtccaaaatcattattattctgtatgtagttgctttgagaagtggattatcactgcctgcttatcgcctaacctcttgcatcttcctctttttctaagttggttctccttagaaaagagtcataggtttttggtttgtttgtttgttttgcttattctttctcaatgattcctaaataaaatgtgttccatttacaagcctagcgattttttttagggtgacaaattcaacttctaaggtgagaaaagaaatcatcttgtgtttttcagcttttatgtgatcaccagtaataaagattcaagttgacaaattgtgttgctgatgcatgagacagaataaagttaatcttttcaaggctatctggttctgcagcagaaagagtaaacaggaaagtaaaaacatgtgacagaaagctatgtgggtgagcagatctgcaaagagaggataagcagaaaacatctgaggggggactcttagttgttttcaatcttttaagttccatagaagtttcccacagttgatctttaccaagctctcacaactttgggggaaaaaacctctgcaagatgtccttggatatttagttattagagctccttctggaaagactgaacaagaaatttgctttatttttggctagaaggtatacaaaccaaacttagttgagaaataaaatgagtgtcttcagcttctaattttattttctctttcaattaagatgttccagaaaattattaatagtatatttctgtgtgccatccaaatgggtggcttactcatatttacttgaaattcacaattagaacctccacataactcaatctccaggccaccactactcagtaaaattggtttttatttagttagtgactttcaacactccccccctcctttcttggccaagaaactgcacagttggattttgagttttgcatgagacatacaaaatttgaattcagatagagtactagtgatgcagaagtggtaagtaggtaagtacatataaatggtgaatgtaaaggcattcaaaagatctagtcttttaaaaaagggaacctggagataagtcaatgaaatagaacatcataacagtgtaataggctcctgcttccagaaaaatgtcatggaaaagtaaagagatttattttgtaccaatatttatttttaaaactgaggtctattatttcctctaatggttttatttcatttcccaaatgattaaatataaataaagtgagaccatttatttaatacaagctgactctggtttctgatgcaggctaagtatacaacccaaaaaaaagagatgtggagtgtgaggctagctaacaggttactatccagacatctcctctgtttttcccaattagccaaaacagcatgaggcccattattttcctgtccataaaaccaaaaataaagaggaggattttctttcctgggaattatatttgtatatattctcattattattttaaagttcctctttttcataaaatatttgggagaagaaaaatgcactgaaccttagatttatgtactcctagatttgtaaagctttaaagtatcatctaatattatctaccactcaaaccagggatctctttgtatccattaggattagctttagttgcatcaaaaataaaaatagaaaaaaattgtaagcacaatagaagtttatttctctctcctattaaaaaagcccaagatacagagagtgacatcataaagtagcagaatgggaagcattagatcctccttcccgccatggagacagatttggcaataaaacatggaacaactccctctgtgagaaatccagaaaccagttaaggggctcctgcactccagagaagtgcaaaggcactccaggcctatatgaaaattcatggcactcatgctataatctctcccccaatagagtgccatatgcttgagagaaaactcccagcttctagtttctggcttctccctggggaaggaaataaaagactggactgtacttccaatgtttttactttccagggggctggatgaggaactggcttttgcccacctgtctgggagcactaacaggggcaagcacattctagatacctgggggaccgtgacaacaaaaaagagctgtgcatcacgctgctgctacccaggaatcatggtacggcagacagaggtcaatagagtttggcagtttcttattcagggagaaatagaagagtagagcatgtgttcaacatctggcttttcatggagctgcctgaggtactggtttctgtctatcttgatgtggggagctgacagaacccagcatactttagatacctggggttccactgcaagtaaaaaaagggctagactgtatggtcatgtttctgcttcagatgacccatggtgaaacaaaaagacacagaaggagcaagagattacaagctccttaaaacaagaaactggcaaatccctctaattaggaatctgcacacatgtctagagaagacacattcacagaaaagacttgagaggcccccagaatctctagccaggcttataggttaagatctttccatgtataaagctaatccttagagactgggagaggtggctgatttttcaaatacccagataccaacacaaaatcacaaaaattacaagacacaggggaaaatggcccagtggggaaaataaaataaaactccagaaattgaacttaaagaaacaaagagatatgaattacctaaaaatgagttaaaaatacctgtcatgaagatttttaatgagtgtagaaaaatgatgcatgaacagaatgacaatttcaaaatagagataaatttttttaaaaaaagaacaaagcagaaatttttgaagcttaaagatgcaataactacagtgataaaagaaatcactggaagggctcaacagctgacttgatcagggagaaaaaagaatcagtacactcaaaaatatgtaatctgaaattatgcaataaggaacaaaaagaaaaatgtatgaaaaagaatgaacaaaatctaagggtcttatgggacactatcaaacagaccactgtatgcattatggaagttgcagagggaaaagagaaaaagaaaaggaaaaacagtttctttaaaaattaatggccccaaacttcccaaatctggggaagaaaaaagacatccagattctagaagccaatggagctcaaaaaagatgaatccaaagaaatccatgtaagatacattataattaaattgtcaaagtcaaacacagagaattttgaaagcaagagaaaagcaatttgtgccacacaagagaacctcagtaagactcagaggatttttcagtagaaaccttgctgaccaggagtgggatgatatatgtacaaagtgctgaatgggaaaaaaaaaaaaaaaaaaaaaaaaaacttgctgaccaaaatactatacttagcaaaacatttctttaaaaatgaaggagagctaaagacgttccaaaataaacaaaataaaagtggagagagttcatccccaccacacctgccttacaagaaatgctaaatggagtcattaaagttgaaatgaaaaatgccaagcagcaaaatgaaagcatataaaagtataaagctgtctggtacaggtgactatacataaatacagaatactgtaatactgtattggtggtgcacaaatcacttttaatttttgtatggaagttagaagacagaagtataaaaataactacaactataaaatacgttaataaattaaaaatgtttgaacaaaacaagattcagttatatgcattctacaagagatctactttatatttaaagacacacacaggctgaaagtgaaaggatggagaaaagatatttcatacaaatgattataaaaaagaaaacacaacataccaaaacttatggggtacagctaaagtaatactaaaagatgctaaaagaaaaaaatatagctgaattaaattcaaaagagttcaacagagcaaagagtggttcacgaattgggcagtctcctgagccagagtaggctcagagattctagcacagtcaggtggaagaagaagatttatggatacggaaaggaaactgacgtacagaaaaccaaagtgaggtacagaaacagtcagattggttacagctcatagtttgccttgtttcaacatgattcaattgattggctaaagcttggtgatcggcaccaaagtaggctatggtctgtatacaactccattttggttatacttcacaatgtacagagaaacctttaggctgaacttaaaatatataaggaggcagctttaggataaacttgagttaacagagataagttgataacaatacatgcctgcattaaaactgaagaaatatctcaaataaacaatctcagtctatacctaaagggattagaaaaaggacaaactaagcccaaagttaacagaaagaaggaaagaacaaagattagaccaggaatacataaaatagagaataaaaacaatagaaaaaataaatgaaaaaagatttggtgtttttaaaagatcaagaaaattggcaaacctttagactaagtaaaaaaaaaagacacaagatacaaataaataaaatcagaaaacgatgagatggtgttacaactgacgccatggaaataaaaggattacaagagactactgtgagcaattatataccagatccaggacctctaagtttatcttgggaccttaagagacaaggatcgcccaactcacaggtatttgagattaaacccatggctgggctcagctttaaaaggtcttacctgagatcccttggggaatagagctccatcaaagccagtccaaaagacctatgtagaaagaatcattcttgctgcactttatgcaaataatcaggccaagtataagactaaggtctgtttcaaaaaccgccagtcctatgatgatttgtttttttaacaaacatgaggactggagagagagaaattatgttccaaaacttatcatacatttgtcattaaattctaaatgcactagttgtttttaagttttcacttaccttttagactaaccctgcttgttcctgtgaaccaaccagcaatctctggctccagctcagaaagaacaagagggatggataatgtaaaaatctggatcaatattctaattctgagcaattatcctgcaaatcctgccaggggattggaatcaataggatgctcattactcggaggtttccttttgggaaagtaagaacaagccagctaaccaaagacaaacaccatgcacccaaatcctagcaagcataactatagccaccaggtgtttgggtgtgtcacaggacatccttttctctctcccttgttggaggaggactcagttccacagtttcaccttagcattcagcttatgataaggagtccatgcaacacccccatgagatacatttttgtcccaaactaattccaagctttgagtcaaagccctaggaaagaaaactggatctaagggatccagaggcagacgacaacggaggttaaaaggcacagtgcacgtgagtgtggctgattcctgccgattaagccaagcccaagcttcctgtttcatggataaaggccacattagtatccatggcataaatgaggtctagagaattcaaggctaccgatagcagggaagatagggcatacgtgggaaggagcagatgattcccacccgttcgaccccctgcttcatgggtgcaagccgcttttacactcatggccacatctgccaaggttgacaggacttggggatgcaaggacagaagaggcaaagaggactctcttccctgtctctctcacgtacctcgggtatctgtcaggcagagaagggaaccagggatgcctgctcccctctttctagatgggtagccattcatcttcagtctgtacccctttcgaatgcatcctgaacccctgggactcctttgaaaaaaaaaagtatcttattttttcttctctcctcctctgtcctctcttcactaataggtaattgtgtccctgtactatggagcacttccctcagatgcatcctccaaactggaaagagttaatttcccaaactttaaactggttggcttggggttaggctcaggggagggggaaccgagaagcccaacatactggcaaatgggtgaagtattttaccagctgggaatttggtctccccgtccccatgcaaactggtaaaagggccttataagttttgagctgttgttacccttccccttgtttcgttttgatacatgtttccttttttcttttttgaggaggagtctcgcactgttggccaggctggagtacaatggcgcaatcttggctcactgcaacctccgcctcccgggttcacgtgattttcctgactcaccctcccgagtagctgggattacaggcacacaccaccataccgtactttctagatgggtagccattcatcttcagtctgtacccctttcgaatgcatcctgaacccctgggactcctttgaaaaaaaaaaagtatcttattttttcttctctcctcctctgtcctctcttcactaataggtaattgtgtccctgtactatggagcacttccctcagatgcatcctccaaactggaaagagttaatttcccaaactttaaactggttggcttggggttgggctcaggggaggggaacccagaagcccaacatgccagaaaagggtaaaattttttaccagacgggcttttggccttcctgtccccatgcaaactggtaaaaggccttagaatttttgagctatccctacccttccccttgtttcgttttgatacatgttttctaataacccagtttgtcttgccttcaggccatcgaactccaaagggtcatgcaaacagagcctctgatgatggccccttctgctgggaagccttaggcctctgagggagatctgatagccttttctccaaaacaacgccccggtcagcaggaagcagttaaggtcggttttcatccttatccttttccttattctaacaggagttagatgtacttctttagaggggcgaatgagacagccaggtgggaaggggccccccaggaaaacaccaaccagcctgcacactggggtggagacataggaatttgcgccctttgcagcagtgaggagcctggccccacctctccctgtgtggaaactgggattcaaacagcatgaggtggtaagtgcaccggcaggaactctggccttgcggagattccccattctccctttttcccttttcactcaataaaaccctgctttgctcaccgttcaaactatctgggagcctaaattttcgtggccatgggacagacaaggagctagtctttagctgaactaaggacaagtcctgcaacactgagagcagctactggtggcagagcatatgactgtgttgtatgtgcaggtattgtaacattgcttagcattccgaagaccttaaatcactgtcaaggactaaaaactccaatgatgactggaaatatctgttccacatccaaaataatctatttagaattgcttccctagttcaccaggtctctatcaaatatcagtgtttttagttccttccaaatcatcactttggcctctaatctaatgtattcctgaattatgctgtagagaaaaatgcaatttccattatgtcggtctccctccttaagtttttcttcctcacatcaaacatctctaacatttagaaaaagacaatagtttgtaaatgaatccaggtgcacaattgtccaactcatgaaaataacttcctaaatcattattcattgataaatatattgaccaaatcaatgtaagtatttcagttgatcagtttgtctacagagattgtggctacaaaatgaaaaatcacattcagcttattcatttgttataaatgtaaaaagagcaatggaaataggaatcacgatattctatgcaaaaccagaagtctactttattttttcccagagacactgatggctgattttcctagccatgttattaaatataattggttagattacattctaaattaaaccagttcattggagtaaacctctgtatgggacacttggcatcataaagctgtttcacagctggatgatgtagaatagccttcagactctttgtaaaggtgtaccgttagatcaaatgaacacacaggtagtaatattatattagaactatttctgtaaaatcacaactaaattaacattttgtaaaaggttcaataatatcttagaaaactgtggtgtgttcacatgtgtattgaatgcatgcatttgcgtatacatattaggctttgatcactaatgttaaaaccagctcaactttggacctttagtgaattgtggttttaacatagaattaacaacctgtatttcaaaattgaggtaaaatggtaacaatctgtctgtaaatatactaatattgcatatttttgcctgctcttccaatgttggacattagccaggtaaggtggacactactgagaacatagctttgagctggttatgtgtgtatgtgtacagcactctgcgaattggtaattctataaaagatggaaattttgcattagaagccaagaaataagattaaatcagcactagtggacaactgagattattgattattctacattattcatatccatgatatgaagtgattctggaattattttgctagctactagaaaataagctaagactaatgacagcttgttgaatgcatctgcaaaattccatcaataggaaagcaagaacagtcttttttaattaaatcagagaatatgacacagtaacagttacctgtcctctaagttttattactttaacaacacacaaaattgccaagattttagccatttgtgaagtcctctaactatatactagagagcgtcattgaaccacctgaaccaccttataaaatagagctgcctctgctcgattattttctgaatattgcaatctatttatatttgtgaattgaaacaatggaccagatgataaatatgcatataaggagacaggaatattgtcattttttctggaatttatctataccagaaaatagaatgaatcttctagaaatatgaaaaatactagcctgacactgtttattcttactttttgagaactcgtgtaagtcatttgttctattttgcctcaagttctttattaataacagtagtgctggactatatcctgtatgaaatactgtgatcaaattattatgtatccagggatttcagcctttggctgtgaatcattatcaatgggaggaattttgattctgcaggctcagggtagaaccttggcatatatactcttaagatgggccacaaatgattctgatattcaaccaaggtatggaataattcttctatgttttttgattcaatgaacaaaatggaaatctttaagtctatattatttcttatgccttaactatattttatactttgctgagaaaaagtgtcagtgggtatagcagtggtaaaattgctgcagggagtatcattataagacaagatatgaacattgttacgggtagaaaaatgatcaaaatgaatagtgtattaatcaaggttctccagaaagataagaaaatattaggagatatatgtgtgtgtgtgtgtgtgtgtgtgtgtgtgtatgtgtgtgtgtgtgtgtatatatatatatatatatatatgaaaatgctctgtacagtctttgcagctggttaataaatcaaaaattattcaaaaacaaaagatttccaatttaaactatatattgcatcatgataaattatcagcagtctagatgttgctatggaggtatatataaatatatgtatacagagagagagagagagagagaaattttaaggaattggtttatgcaactgtgggggttggcaaatccaaaatctgtggacctggttgtaggttagaaattcaggcaaaagttgatgttgcagtcttgattctaaagtctggaaactcaaacagatccgtcttcttgggggaacttttgtctttttcctgaaggccttcaactaactggatgatgctcacccatcctatggagggtaaatctgatttactaaaagtctactgatataaaatgttaaatgacagcttaaaaatacctccacagcaacatctagactatttgaccgaataattgggcaccatagcctagccaagttcacacagaaaattaatcatcacagaaagtaaacttaccaagagctaataaaagcaaaataattccaaagtgggttggatcagaatgaaaatgattgggtatctgaaaaaggctggcaggtgccgcatgtgggtggaagagccagcaaggttgcagataatgtgagtctgctggagcataaaaatggtgtccggagttaagtctgcagtaaatgttgtaggtaactaagagcagtcagaggcacacgaagatgtcagaactggtactacttaggctccattaaaccaatgcacttcatcacattgattttcattgtttaattttcttatacacttattcattacatgctgctctgctcagagcattttgacttccttgaacatttatttattagcttgttggtgttcattttgcttgtaagctacattattcatttctggagtaacacttcatactaaggcagttgttgcttgttgattgaacaggccagttgtaatttctctgaactctatagtgatgtcagttttctttaacccaagaagggctgtttgcacaagtaagttgctttcactcctagttgttttttcactgccagtcaggtactcaccaaactttgtatcttctttagtcttctatcatgacttcattatcctgtgggtccaccagttatgtacgtgtatctaagtgaattattttgtccacgggctctactatctgatttttacattcccatatagcacttgctgaaatttaattttctccaaatttggtgactttggataataccataactactgtggtttttaaactctttgaaagtctttgcggcctataaaaagcacagggctttagaaaagtaattctcacatattggtgtgtataatttagagaccatgtaaaatgtagatgactggctccactttgaaaaaattatgatttactatatatgaggacagaggggccacaagtatgcattttaaagaagctacatctttctctcttatatgattaatagtgatttgctgataatttatcatgatgcaatatatagtttaaattggaaatcttttgttttagaataatttttgatttatgaaccagttgcaaagactgtacagagcattttcatgcacattttacccagcttcccctaaaattaatatcttacattgtacatgcatttaaactaaaaaattaacattgacatattactattaactaaacttcagactttatccagatttgtagattttttatacccatgtcctttttcagtgtcaggatccaactcagcctaccacattgaacttagtttgaatgtctctttgatctaaagtctatgaccggttctctgcctttaattttttcccatgacctttatgattttgaggaatacttgagaattttgtaaaatgtccctggacttgggtttgttatatgttttctcctcattagactaggattctggaatttagagaagaatgctacagagatgaagtgtctttctcatcacatcctatcagagtagtgcatgataccaatgtaatgtctcactgctgatattaacattgatcacttgcttaaggagagaactgccaggcttctccactaaaaggtcactatttttccctttccatattccattttttagaatccagcccacactctgggggggggggcatttaaattccacctcctggagggaggagtatctatgtacattttttaaaattcttcgggagacagatttgcatcttttttttcatttatttatttgtacaatcatttatatcagtatggactcatggacattttattttatattgtgttataatttttaaattttagttctcatgttgcttaaattgttttaactttgggcattgagtgctctttcagcttggctcctgatctgcttttattcttttgttttctgagaacttcctattttcttgcattacataatactccaggctcatcttgtgttttcactgccccaggcctagaattactcatttctccaaggatgtctcgttttgcttttgttattttggataattgtatttagaaaccaagatctgggcactggatgtactttttgctacttggatgtcattttttttctagtttatcagcagacagagctataaaatatatgcatgtatactaaccaatatgtgcacacaactatatttatttctttacctatatatctctatacatgttaaactactatgtattatacattttgttttgtgttctctgttgtcttattaagttttttgttttgttttgtttgtttgtttgtttgtttgtttgaggtggagtttcacccttgttgcccaggctggagtgcagtggcgcgatctcggctcaccgcaacctctgcctcccaggttcaagcgattctcctgcctcagcctacggagtagctgggattacaggcatgcgccaccatgcctgcctattttttctatttttagtacagacagggtttcaccgtgttagccaggatggtctcaatctcctgacctcgtgatccgcccgtctcagcctcccaaattgctgggattacaggcgtgagccaccgcgcccggccgtcttattgttaagttttaataattatttatgtattctggatatgagtattttgtataatattctactttgtaaagtggaaaaaaatgaagtggctgtaaagtacaaaaactgttttaatgaacagccacatgaaaaattttgaagatgcccagttgacctttaggagcttcaatgtgtgtttttctctgggaatatttagaatatagaagttttattcaaaccctcacccactttagataagtgagaactcatatgagcttgctagttagagtactgttatagagaattgttgaaatattggctcttgaatttaacatacattccatggaatttttccaagtgagaaagttaaaaacaaatccatatcaaaatggtcttaccaacttcacattatgaaatctactaaatgtgttgacagtttaacagattcttataattgataaatgaaaatatttgtgacatataaatagatctgtatgatttctgcttcccctttatttagacactgaaagtagaatatttttattttcaaatagtagtaatcctatataaaataacaatactttactggatgcttattctgtgccaggcactatacaaaatcatgttatatagattatcttgatttacacataaaccatttattagcgttaatgggaaacctaagaggaatatatattgtgtctattttacagaggaggagccacagggaagagaggcattgatcatgccttatttacaaggaggaactagggtatacctgctagtaatggtagaaaacattgttcagctgcacttaacaagggaaataagaaatatttcttttaaaaatggacaagaatgtacagaaaaaattattatgtgattagaaaataatatggttaaggaataatgcaagctgaatttgtctataattacattttttataaaaaaatctttttcatagatatagttttaaacaccataagagagagaaaaatttcactgatgttattcaaaggaaaatcaaggatcgcaactggactgagcagaggggatgaagatattcaatttggaaagaaagaagggaaactgtctttattcacagatgacattatcatatatatagaaaattcagtgaaatctacaaaaatgctcctgaaagtaataagtgagtttgtaaggttgtatgatacaagatggatatacaaaactcaatatttatatatactaacaacaaaaaattggaaattgcaatttaaaaatactacatataatagtatcaaaagcaatatttagaaaaaatctggggagaaattatgtgaaagacatatgcactaaaaaatacaaaatattcctgagaagattaaaaatcacgtaaacaaatgggaaaatgtacctttttcagtggtcagaagacttcctatttttaatatgtcaattacccacaaatttatctacagattcaaaagaatcctaattgaaatcccaacggaattttttttagacattgataaactgattttaaagtttctgtagaaattcaaaggacctagaagaaccaactttgtaaatgaacattgttaaagaactaatacagcctaatttctaggtttattttaaagttaaagtaatcaacagagggtgaaatttgtgtgagagaaaaatctggaagacaaaagagtgccaagaaattgacccacaaaaaaatatacacagctgatattctacaaatttccaaaggtaattcagtggagaaaatatagtctttactgaaattaccagatatacacaggcaatagacacatttttttaaaaagtactttgatctatatcgtgtgctgtttacaaatctttaaacaaatttaaatttaaaaaaatctttgtgacctttggataggcaaagttttcacagatacatcaaaagaagcacaatctgtaaaagagcaaattaataaattggacttcatcaaataaaaaaaaacttctctttgatagacactgttaagacaatgaaagggaaaagccaacgatgaagagaaaaatttgcaaatcatatagatgataacggacttagatgtagaacagaacaagaattttcaaaactaaatatgatatccagcaacacaatttaaaaatgggggaaaaatccacagaaacttcaaccaaggagagataaggatggcaaataagcaaatatagagatgttcaatatcagtagtcattaggaaacgcaaatgaaacccagaatgagattctactacacacctgttagaatctgggctgcgcaggtggcatcagcgctgctccgcctccaggaaggaacctgggctgcgcgtggctggcggtctcctagcgactagagcgtcagggatcaggaaccgcggaaactggagaggtggcaccccagcgagggccaccatgggggaccagaggccgcaggaccggcccagttccccgggcatggactccacgccctggtactgtgacaaaccgccttccaagtacttcgcgaagcgcaagcacaggcgcctgaggttcccgcctgtggacacccagaactgggtatttgtgacggagggcatggacgacttccgctacggctgtcagtctcctgaagatacgcttgtttgtcgccgtgacgagtttttactccccaaaatatctctcagaggtccccaagctgaccccaaaagcaggaagaaaaagctgctcaagaaagcggccctgttttccaagctctcgccagcacagccagcacggaaggcgttcgtagaggaagtggaagcccagctgatgaccaagcatcccttggccatgtaccccaatctgggagaagatatgcctccagatctcctactacaggtactgaaaccgctggaccctgagaggaagctggaggacgcaggctcttgtgagggccaggagaagacaactgacgaacccacggagcctggtaaatacccctgtggggaattctcccctcggcctcccgagactcgggtgtcctgtctccccccggagcctcccaagactccggtgtccagtctccgcccggagcctccagagactggagtgtcccatctccgcccacagcctcccaagactcaggtgtccagtctccacctggagcctccagagactggagtgtcccatctccgcccagagcctcccaagactcaggtgtccagtctccacctggagcctcccgagactggagtgtcccatctctacctggagcctcctgggactggagtgtctcatctctgcccagagcctcccaagactcgcgtatctcatctccatcgggagcctcctgagactggagtgcctgatctctgcctggagcctcccaagtcacgcgtatctcatctccgcccagagccttctgagactggagtgtcccatctccacccagagcctcccaagactctggtgtccagtctccacccagagcctcccgagactggagtgtcccatctctgcccggaacctccagagactcgcgtatctcctctccgccagctgcctcccgaggctggagtgtcccatctctgcccggaacctcccaagactcgcgtacctcctctccgcccagagacccccaagaatggagtgtctcctctcttcccggagcctcccaagactcgcatatctaatctccgctcggagcctcccaagattggagtgtcccatctctgcctggagcctcccaagactcgcggatctcatctccgcccggaacctcctgagactggagtgtcccatctccgcccagagcctcccaagactcgggtgtccagtctccacctggagcctcctgagactggagtgtcccatctctgcccggagcctccagagaaggacgtatctcatctccgcccagagcctcccgacactggagtgtcccatctctgcccagagccccccaagacacgcgtatctcatctccgcccagagccttctgagactggagtgtcccatctccgcccagagcctcccaagattctggtgtccagtctccaccaggcacctcctgagagtagcgtatctcatctccgcccagagcctcctgagactggagtgtcccatctccgcccagagcctcccaagactcggatgtacagtctccgcccggagcctcccgatactggagtgtcccatctctgcccagagcctcccaagactcgggtgtccagtctccccccggagccccccgagactggagtgtcccatctctgcccggagcctccagagactcgcgtatctcatctccgcccagagcctcctgagactggagtgtcccatctccgcccagagcctcccaagactcggatgtacagtctccgcccggagcctcccaatactggagtgtcccatctctgcccagagcctcccaagactcgggtgtccagtctccccccggagccccccgagactggagtgtcccatctctgcccggagcctccagagactcgcgtatctcatctccgcccagagcctcctgagactggagtgtcccgtctccacccagagcctcccaagactcgggtgtccagtctccacgcggagcctcctgagagtcgcgtatctcatctctgcccggagcctcctgagactggagtgtcccatctccgcccagagcctcccaagcctcgggtttccagtctccgcccagagcctcttgagactcgcgtatctcatctccgcccggagcctcctgagactggagtgtcccatctccacccagagcttcccaagcctcgggtatccagtctccacctggagcctcccaagactcgtcgagtgtccagtctccgcctggagcctcccaagactggtcgggtgtccagtctctgcccggagcctaccaagaccggagcgtcccatctaaaagaactgtttcaggaaggtacatcaagcacaatggagtgtgtttctgactctcttcaacgtagacacacatcgagaaaactccgtgacttcaagtgggctggagacctaggagttaatgaagaatccatcagcagtctgtttgactttacccctgagtgcagagcaacctatcaagaccaaaagaataagaaggcaaacgagtgttcctcagggctgaagtacagcatggagctagacgaaatggatgaggtcaaattcttctcacaggaaaaagacttggacgggaaaatccagaatgcaccaaattctcatagtgcacagcatgtgaagatggggtatggagcatggtacctcaagcctaagttggggaaaaagctaagaagtgatgaacctttgattgaccccaagctcgtacttgaaaagcctgatgaacccgacattcttgacggtctttatggaccaatcgcctttaaggatttcattctaagcaagggctatgaaatgcctggcatcattcaaaggctgtttgccaggaggggatggacttatgactctgttaagactcctattcaacgtgcaatgcaagtttacaagtacaaagaagacgtcacagatgcatcggaagaagattagatggttttgaatttactagttaattgggtatttcttgctctcattttaaacatcagtcagaatttatgatgactggccccaggaatgtacaacgttggcaacatctgtaaattcaatacctaatgtttataaatatttcttaatgacctgctttggcttcattacttcatatattttatcatttatatgattaatattcacatatacttttttcacacttttgaagcattgtgaatattacatcatcatttcaattatttgtaaaaatacatacaaccagaaacaaaagcagaattaatcttagaaagagaaatggggtcgggtgcgttgactcacacctgtaatccctcccgcctttgggaggcccagatgggtggattgcttgagcccaggagttcaagagcagcctgggcaacatggtgaaacctggtctctacaaaaaaatgcaaaaattagccaggcatggtggcatgcacgtgtagttccagctacctggggggctgaggtgggaggatggcttcatgccaccacacagcagtctcggcgacagagcaagaccctgtctcaaaaaacaaacaaacaaaccaaatttgctgagtgaaaggataattctataactcttcttatatgaaaattctaatgaaataattatgacaattattttattactatagccaaaataatgttaacactttttaatagtaaaattgttatcttcccccttgtgattccatcaaccccccaaaacaagtttgaaaactatttatcaaaatcatagttgaaacttgagttatgccattttgtcatatctctcaatagaatgtatgtatttcaccatgttcataaaccttcacaacaaaatactattaccaaatcatataaacaagtgcagaataggaggtagcttcaactccctggcaaatctcatgtgcaaaataggatctgtatgagaaaagctaccaagcaacatcaaatatccttacatatctgttcaagttaaaataattttcatttcattcatagcaatttaaaatgcactcataagtttaaaatgataaatcaagcatctgctttacctttcaaaaatagcaggtaaaactgtctgatataggtaaatttgtaggtaaatatatttgtagtgtagatctgaagtgcactttttctttcagtgacgaaagtgtccatctgtaaatggatgtatatgcatatatttcatccaactaagcagtgatatatagatctgtgtatgtgcaaattctgtttctagtgaagtttgtcttgtgggtattatgttcctgaagaaccaagtattttctatgttgttttctaagccaaggcctagaatttctcttcaaattcatcatcataaacttaggttcatgtcaccactatctcttattgtatttctgcaacggtttccaacctgtgtctcttctcgagtatatttttgcaaaatacaagcatggcttgttaattctccaggctcatctaaacttatctaggtacataaacactcacacacacatgcacacacacacactcacatgctcctgcattccagactccagttaatattccttttcttacctctgtgtgtttcttgtgtctttgtacataatcttctctactgttaggacttcactcaggccatgtaatcctgtttcagtgctttcctcatcgaggtcaatttcatgattacttttattaagatcttatatctgtagacaaggacccacattttccagctgtcttccactgaagaacttacatcagtatcctagagaaatgagtcattaatgccttcaaaataagggaaaatcccatacttatttattacaacttctgagaggccaataccatgccttatggctcagagttatctggtttctgaggttctccactgaagccttgggcttcatgcagcagcattcaatgttcagttcctttcagcaagagacagacctactttttcacatttggttgtgtgaccttgagcttcatggaggatgtatcctcatttacacaatggacaccatatcatcaaactcaaattctggtgagacttaattacttattggagtgcctaatgcctcaggcatcacagaattaatacaaaacctgcatttgtggaagagaaggagggagttggaaaggaagaagggtactaaaaatatcacaacagaaatacactatacaaacataactttttgatggtgtttatctggtgatagccttcacctatatcacacacaatcttagccattgcttaacatgaaaaagtagggcttgctttggctgcacatatactaacattaagatgaaaaagtgtaaatgcaaaataagagccactggttatggtttctattgcttcttggtaatggctacttccaggaaaataaactttcctcacagaaattatgtgggtttctctacactgtaattacacacattggtattagttgtcatacagatataaacagaaacaatgtttgatctatttggatttttaacaccagttggacttctgaaaacatcctgacttcaaatccataggttttagaaagagagagaattcaagagagcttgatatgtaactgtgcctgtgtagcctaaagctatgaatggtatattccataaatactgtagtaatcaattgtattacagcatcacataggtttcacaaaagctttggagaatttggctgtaggaatatgtgatttaacaaagatgaagggaattattttcatttctgagagtctgaatgaatgagcaaggcttttggagctaggcaaaaatgagttcacatcccagtgctgccatgttcttatcatatagctttaggcagaggcagaacaggtggagggaagatacagagggtgggctgaagggggaggaagctaggaaccctttctagggctagtgcacactggaatgtgttcctggcccccagtgactcctacagaggggatgagtttaacaggcaaggagctacccactctcactgtgggcctttggaatcttagcaagaggagaccctagaccaccatggacacttgagttgtcagggaaagctacttagagaagtggtagcggtagaactccagccacaggcagagcacagagggtgtcctgtgggagcaactgtagtggagcactgtcagagatgtgcatccccctaggctagaattgcttgcacaggataattttgccctaggggaacctttggacctgaactctgcagggcagtcttacccaggagacaggactaggccaacctgagcacctctcagtctgctggcctcctgcggggccccagcctggccacagctgcttgcagcacagctgctaggtgcctcttggagcccacattatagctggtggaccacacctgactggcagagtgctccagccgagtggcctctgaaaacacataacagctcgtttgcacccatggccaccctccacatcactatgctggtgcatatatgcccaggcagacctagccttctcttccccgccagcacaatggtacacctgcaccctaccttgccactgctgctggagtgagtgcacctcctccccccacccccaaccccaccacaccaccattgtcttcagaacattggtgggcacagagccacccagcccccactgtcagcacgctgcccatgaacctgggccaccagagcaaaactaggcatggaaaacagtagactagcccctagccttgagcggctgctgctgccagcatgaacgtgcacagagggtgcacacagtcctgcacccaccaatgcacccacctccatgctataaccaccagctgcagggacatgcacacagtcccagtgggggctcctcacccccaccaagccatactgccaccactgctgcttcaaatactcacatcaagactagcaccccggccatggaaataaaaaggattataagagactactaagaataattgtataccaacaaattggaaaacctggaagaaatggataaattcttataaatgtataacctactaaaactgaatcatgaaaaaaatagaaaatctgaacagattcataactagtaaggacattgaatcagtaatcaaaaacctcccaacaggctgggcgtggtggctgacgcctgtaatctcagcactttgggaggccgaggcgagtggatcacttgaggtcaggagttccagaccagcctggccaacatggtgaaacctcctctctactaaaaatacacaaattagctgggcctggtggtgggcacctgtaatcccagctactctggaggctgaggcaggagaatcccttgaacccaggaagcggaagttgcagtgacctgagaacaagccactgcactccagcactccagcctgggtgacagagcaagactccatctcaaaaagcaacaacaaaaaacctcccaacaaagtaaagctcaggaccagatggcttcataggggaattctaccaaacatctaagggaagattaaggccaatctttcttgaaatcctccaaaaaaatttaaaagatagaatacttccaaactcattttatgaggccagcattatctaacaggaaagccaaaaaaaaagacactacaagaaaagaaaactacgggccaatattcttgaatatagatgcaaaaatcctcgaaaaataatagcaaactgaatttaacacattgaaaggattatatacgacaaacaagtgatatttatccctaggatgtaaggatggctcaacatacgcaaatcaataatgtaacacattaacagaacaaagaataaaaattacatgattgtcttaatagattcaaaaaactatttttaaaaattcaattttattataataaaggcattcaacaaacctagaatacaaggaaattccctcaacataataaaggctgtatatgaaaagtccacagcaaatatcatactcagtggtgaaaaactgaaacttttcctctaagaccaggaacaagcaaagacgcacacccttgccactattattcaacatatttatcagagcagttaggcaagacagagaaataaaagtgcctaagttggaaaggaagaagttaaattgtccctatttgcagatgacatgatcttatatatagaaagccttaaagatgtaaccaaaataataataataagaagaagaagaagaacaaataaatgaatttagtaaagttacaggtaaggaaatcaatatacaaaatttagtcgtgtttttatacactaacaatgagctgtctgaaacgaattaagaaaataatctcatttataatagtatcaaaaagaacaaattcttagaaatacttaaccaaagaggtgaatgacatgtactttgaaaaccatatgctatggtttgtatgtagtttgtctccacgaaaattcatgttgaaatttaattgccagtgtaatggtattgggaggtagtaactttaaaaggtgattaggtaatggctttctcacaggagtgagttcttggtcttgtgagactgatttcattatcatgagagtaggttgttataaagtaagcctgcctctcatgtttggcctctttgcatgtgcctgcttccccttccaattctctgccatgttatgacacacaaagccctcaccagaagttggccacatacagccacctgatcttggacctcccatcctctacaattgtgagctaaataaacctctttactttataagttacccaggtattctgttgtagcaacagaaaacagactaagacaacgtataacgttgattaaataaattaaagaagccatgaataaatggaaaggcatctcatgttcatggataggaaaaacatttttaaaatgtccaataactcaaagcaatctataattcaatgcaatccctatcaaaatccttatgatattttttacagaaatagaaaaaaaatcctaaaattcatatggaaccaccaagaactctgaatagcaacatgaaagaacattatttctctttgttcttcagaaaaacagaacaaaactaaaggcttcatgtttcctaatttaaaaatatattacaaagctacagtaataaaaaaaacagtatggtactggcataaagacagacatataaaccaatgaaacagactagaaatccagaaataaacctgcccatatatgatcaactacgaagaataaacaatgcaaaaagggtactctcttcaataaggtggtgggaatactgtatagccacatgcaaaagaatgatcagatccttctcttgcaccatatacaaaaataaactcaagatagaataaggacttaaatgtgagacctgaaactctaaaactcctagaagaaaacatagagggaaagctttataacttttgccatgacaattatttcttggaattctcactttgtgagatttagtggaggtcagacctcacttccttttacataattgaaaatgccacattcagatttttcacaactttccttgcagctaggatgtgagtacatgacaacattctgccaatcagatgctcttgtcagtactatcaggctttgaattgaagctaaccatgtcaaatatctgtgactatggagattcaccttgggtggaaagtttggctgtctcaagatcgaattcccagggaagcagagacagggtcttagtggcagcatgaaatgtcccatgctgtggtagttctgacacaaactgtatcatctattacatagtgatggtggcaactgagtcctcaataggcttttatgtggggtgatttagagcgacattcctgcccctcagcctctgcccagctttccagccctcccagagtttcagtgagctacacaattttcttttaataaattccttttctgtttaaatcagcaaaagttattttcagactgatataacctctgatctttgtaagtgtccagggtttctcttttttcctgatcttcgttgttctaactttttcagtttgaaattaattttcttcaatgaaaaaataaagataaaagaaatggaatagttttgccttccttctatcaactgttatgaaacaaccaatactcctgtaactttttgtcccttctttctcagagaataaaagaaaggaattgtgtcttctttttgcatgcttacttaataatcctaaactctccctgcctttctgatgccattctggggcttcatgccattcctccaattcatatttggttagttgcctccatctcatctttgtgtttttaagatctttgtctttcagcaaattctctctgcaactccaatgaactcttcagctgcctctgtattaggcaggaactcaactcgccctgaatttctccaaaagagaactgatgggttgaaaccaagagatcctggcatggcttacactaagcgctaaaataatgatgtgaaatttttctccctttctcctgcctcctcttcctccttgtcctctcctcaccccaggttggattcattttgaggcaggctttttctacagtttagcaatcttcgtagaaaaagagtgtttctctgtggacacataaaggggaaccacagacactggggtggtggacagtgggaggagggagaggatcaggaaaaataactgatgggtacaaggcttaatacctgggtgacaaaatgatttgtacaacaaacccccatgacatgtgtttacctatataacaaacctgcacatgtgcctcgaacttaaaataaaagttaaatttaataaataaataaaatgaagaaaaggagtgtttctctcaagattttgactctctttggcctagttttggtcacatgcccattccagaatgaatctggttggccaagctttggtcacatgcttatgcctgggaacatgttatgagagtgggaaagaagtgattccccaatgaaaatttagggtgttgatgccaaagcaaaggctgtgggctgctgggcaagcaaaatcttcccagtttgtctgagtgtttccccccaacacttgcaaagtaactgtcaaagagtttattcttgtctgtgagaattttgaaataactgcttcccaaacatgagcccagacttatccaggatctacgtcagacaatgtgtatgacaacaatgtactactcttcctattcctaacacttctgaatcaccaccatcactacccagtttttccttgtggttaatattaagtcaacatcagtggttcccattactcttactttccattgacagataatacatttatttggggtagacaacaatgtatcaggtaatctgtctttagtacaatgagatttctgcaagtgcccagtggctgaaaccctccatcatcactgaaccagttttgctataatgctaagctaattggaaagcattacaggtaaaaacacctcaaagttctcaatctcctccaagttttacttatccttttccaccaagaaggaagattcgataaaaaatttatttccggtttttccatacactagtatgtgaccttaagcaagtcttctctactttttagcatctcagattttaaatctattttagaagttggttgtaagctaaagtgcggtaaaaatataataaaataattttaaaaataagagattataagatcttagctatacttattaaactgttttagtttgaaattcaaatcaagcaaatttggacaatttattggctcacaaaatcaagggaatgacagggaaatagctaagcagaaaagacaactggaattaggaacttgagtgttgttagaacagtctcattctgtttgtattcctctaagcctaggggaatatggctgcctcacaattcacagtgttctccatcaaagggaaactgagacatattccactgattcaatttaataagctcctactacataaccgtcattattcaaggtgatacacatacatcagagagcaaaacaaagttccggatcctcacgtagcaccccatccagtggccataaatttaaaattctaaggaagaactctctttagctctgtttgagtcataggcttactcctgggccaatgagtgatggtcaagtggagctcaagtggaacttgataaatggaatggtcttatctctagaaatttagattcaaagaatggatcctgagaatttgtgtttttaacaagccctcccaagtgattgtgatataggtaattattgaaagaaacaggaaaacacttttctcttgcacaaaggcaccatcattttttggccttatcttagaaagtcacatttctgtctacataccctgatgctagtagcatgctatcctccagtaatactttctcgtacctttgtattaagggccaaccatgacgatgaatgaagaactatacagtgaaaatagcaacaaccacattgaaacaattgtggacttttataaagagctggcctgaggcagcaactcaggcatggggaagctcatggaaaaaatgacttttctttaacacgtgtgacaagtgataaaaaaaaatactttaggtctttagaatttctgcaacagctttttcttttggtcatgctatatgtttatggaagcctaatttgcatggaaatttgttgaaggtggagatcagtttagtctcataggttgacttctgaaattcaatgtccaagtgcttgatgggaagaatattccaaggcattgtaggcaactgagtcaaagcaaacatactcaggaagggccactttccctctccaggggtatgtccctgctaggcgatagagaaaaggtgcattttgcttgtcagccaggttgctaatttcatttgcatgctatgagagttttgcatgtctgtagcccaaatgtggctgaactgaaaatatgttagggaaacagaattcatgaaaggaaattgagtaagactggtttggatggcaaagaaaagagatttgatgaaatctcttgtctcgtttttcatttctaattatggctttttgaaaaatctgtcagattacatttgaataattttagtaggcattaatcacaaaatagtccaaaagacagaatttgcagtagtacaattattttcaccatttcttactttaaactgctttttatgatgaattcatttcaaagaaaatttcacttggttttaagtcataagacttttaaatatttgttctgccttcccagaaaaataatcgttcaagaatatatggtttaagttcttcagatatcacatttgacttaattaatgcatatgtctataaaatgaatgtgtattctatcctatttgagaaaacacaacatctttgagcacttactctgtataggagtctgtgaggcattggatcagggagagggcagagaaaaggggcacaatgggaataaatcagttcccattcataaggaccctttaacacaatggaaagtacagatgtataaaaacataaatgactaattgataaatgcaaaataaaaaagtattaaagaatgctgagtgtgtaaaactctgtgtatgtatttttatatatttatgcagaaatatagcattaaaagtgctttcagtcatgattctcagaaacagaccctgagaagatgattggcatgcaactgatttattaatgatattcttggagggcttgggggactgctaatgggaatgagagaagcaaaaaggaaaagataaaatgacaagtcaaagtaccattttagatccagtctcacagagggtagcttcaacatgttatcaggagtaaactctggagtgtaagttacccttcagagttgtccgaatctgaatcaaagaagctatgatttcatacttccgcatctacaatcactgaaaagcagttcctttagcctgagtggcattttcctcctgaagaaaagctccagatgttggcctggttgttgaaagcacaccaaagtgaggaagggctaggaaaactcctaaaaagtgatacttgtgccctccacagcaaatgtggaatattttgcctaattgcaaaatatacattatctctttttgtaagtcattatcataccatgatatttccacttaatcctgctaaggaaaatactttcatattttcatgccctactgtagacatttaaaacatataatgccttagagtagatattttaaatgatttactgttgaagtaataagttaatgaaaaaagttaatgcataaaaaggtaaaagtcctattctggtaatatgaaattttccttggaagccatatagatgaaataagagactatagttcaggaatttacagaatgcattatttaaaatttttcctttaaacagtaactgtctcataaaaaatgcatctcataactatcattttcaaaaccagatgctttctggtggttttctattttgcctgactagaaactatgccatgtacatggcaaatctccatgcggggagatgatttttggtttcaattattgatccattttatacatatttatggagggcttaggagtcctagatgttcaaggacatctggtccctcttctgaaggagcgcccagagtaggaggggctacagcacccacggcagattaattctaatcagaggaggtggcatacaggatggaccctcacctgagggcacttagggtgagctgcacagggtcagtatttgaatgctaaatttgcattttccaggtgaggaaggagggacaaagacattccagctgagacgttttcccatttgaaggcagaaataacaatagctagctaatatttattgagggctctctttgtgcccagcactgtgtaatatgaatcaacatggatttgtgaaagaccatgggattttgcagcaatctgactaaagtaagtagaatctgattgtgaagggtctcatggaatgaggttcataaatggtgtcagagtaatcaatattattaatgaactgatttcctggggtaatgaggaactcctaacacgaaacagaatcatcccttgcctttgggagatcattacatctcctttgggagatgcaaacatgcatctactttggacacaaaagactattcacacccatggccttagaatcagaaaccgttaaacacaaatgctcatgactatctgcctcaaacacagcaaaacggaggttggaacaaaggtaacactcatgaccttgatcttattaaccccaatgattcatttgagcactctagaataacgcttctcaacttttaacatgcatggagatcatctgcaaatgttgtttaaatgcagattctgatttatgagggggcctaagattttgtacttctgacacgtttctgagtgatgctgatgcttccagtccatggaccacactttgagtaataaaactctagttcactggttctcagtacaggatgcacatttgaaccacctgggaagctttgcaaactactgaggcctggattccacccacataaattctgattaacatgtcagcggtgtgttctgaacattggaagttgttgaaatttcccaggtgattctaataagcaacaaagagtgagaaccactatagttagttataaatgcacaggtgaactatcaagggtatatttgacatgtcgataaagcaccgttgagaggagaaataattttattgaaaagatgattttggaaaatggaaagagtatcacttctgattggaatagaatgcttaacaaagttaaacaaaattaccaagacatgcaaatgatgtttcatattgcaatggtcattcagactttctattaataacttggcagttaggattgaaagtgtgtcctttaaagttttacatatatcataatatcaaaatcttagtaaaaatattttttctatttaaaaatgtaatgtgtgctcatcatagaacatttgagaaataaatctcataatttcaattactagagaaatgtaatattttcatatattttctttcataatatttcatgcattttcaaagggtgtgttgagttttacaaaactgaaaatgctgtactttttattaaaagtatcttaaaagtataatttgtaatggctactgttgtgtatctagtatttaattatttttgtaaatcaatgtgggacatagtattcttttctttggtagagtggctcatcattgtacctgttacagcagaacatgaataattcagttaaataaattttaatagactgccattctccatcatttctaaagcaaatatctatagtgagacctcaatatgaaaattatatgactataaatagtagcaaaactgagctgcaacacagaaatatttttgttagcgggttgggctttactttccctaggcacaaatggggcttagactaaaagtacacatagcgatgccttatcttgcttggttattcaaacatctacttgctaatttggatgctggaactgctgctgaagagatatatagaaattgctcaagacctgacaaatatttaaaatagctcaaaccaaactatgggaatagtctttggcagaaaggtgtaatcagatttgctctaagatgtctgaaggaggagtctttcttattgttagcagtaattgaacagtaactctccttatttagtttgatggggtgctagagatggattttaaaaatttacccaggctagcagttggtagctttatcacttcattaaaactccccaaatacttcatgtatataatcaatgatgagactttgaaaatggttttataattattcctttactatttttagttggataattttaagactgtattcttattagatcttatgtatcttcccattctagaggttgttataatcctaaattttgtgtttattatttccatttatgtctttatactttatgtatacacgtaaaatttatacatacatatttattttgcacgttgataaactatttataaacagtatcatactgtgtgtaccctttataacttgctttttgatcaatgtcgacttttttgagatctatctctattgacacagatagctccactccattcattttcattgctgtatagtatttcatcatataaccatactataccacaacatacttatccattttgcagatgaatattaaaggtgtttttgtctttttcctacaaaaataatgttgtaagaatctactcatttctatatatgagtttctttagggattatacgtaggatgggaaatgctgggtcataagattggcccatcatacattttactaggtattgccaaattttaagccaaaagcattgaagcaatttacaatctctaccaagaataatagagaggttgaattccttaatatcctcaccaagccatggtattatcaaatattttatattttgtcaatttgatggatgtaaaatagtatcttgtagttgctttaatgttcttctcctattttattgcattactactctgtgtattagtcaattatttttcctagtctatgaattgatatcttttacccatttttgattgggttgttagtctttcttctgttaacttatagtagcttttaatatagtctgataactaatcctgtcagttgtatgttataaaaatctctcacagtctgtgtcttgtcttgtcttatttttgtggtgttctttgataaatggacattttgaattttaaggtagttaaatttatcaatcttttccattactgtttgtacttttaagaattccttccctactttgaatcataaagagaatcagaaaatcattctcttttagtttccttctaaaacttttacagttttgctttttcacatttggatcttaaaatatactaaaattgtttttggtatgtggtgtgaagtatgcattcagtatttttctatgttgctaagcaattgcctgaatcatttattaaattgtttatcctttccctacctaactgcaacgtactttataggtggattatatacttccatcataaagttcataatgtcagggttattctatttttctttttcttttttgctttttgtgagaatagcagaccctgaagatcactgcttggattcactatatcattaggagtcacgagttggaaatattctaattctatcttaccttcttcatttattgctgaaatgcttctaaaaacagaattcttctcatcaactatttggttaccttggaatacaggccatataggaaaggcagaataaatgctgggttctttccccttattacaagctctcaaaaaaatatgttgttttcctggtatagatttaaaaatatttgatgtgttttaattattgttgctattcttactgatgtcctctttctttcctgtaattgtttttattttgcagcaaagctatatttgcagagtataaggagtcaaataacttccccatttaccacattccaaaggcaataattttgtattcttttagctaattagtttggtatctttaaataacctgattattactttctttattttcagttttcagcattttctgctgacttccacttactgaagatgaggatttagatcatttcacccttccaaacctccaccacacacacgcacccatcacctatcaccttcatatacttacaggataatcatgattagttcaatcttaagtgttttcactgactatgtaaatactattcacagatgagccccaaataacagtatggttactttttccatttttgcacaacattttattttacgtatagttaataattgccatgtttttttgcttgctcagtttcccacattcttagtacaaactcaatctccacctctattagttgtctaaatctcttcctaacccatttaatggatcaagtgttctctccatttcaacatcttgaataagctctctgaagtcttcaggctacctccaacccagtctgctggtgtatagctgccattgtgtgatctcccccatcccttagcctgtgaatttctgtggcctctttcgttgcatccactgtttcctgtcttccttatctcccttttcctggattatttccttattttgatgaagctcatcctctagtacattgctaagaacaaacacataggaaataaatttttgacttcacttatacaaaaatattttcatttgactctcacacttagttgaaaattgaatagaattctagcttgagaatcattttcaccttaaaatttttgaaggcattgctccattgccttctagctactgggctgccattaaaaggactgaagacattagaatccctggccttttgaatatcaacagtttattcctctctctggataaaggaaggattatctctttgtccctgtgggctccaaaatttagtgatcatatgcctttgtatgggtctatttttgtcaattttgctgagcatctgataggccctttaatgtgaaaggtcatgtccttctgttaagggactttttattactagttctttaacaatctctttctctcaattttctttgtcttatttttctgtaattcttaataattgcatgttgaaccatctggattggttctttaaattttttttatccttaccctattatctatttgtcttattgctctactttgtggaaatttttctcaacattgtattttaaacttttaatattttcattgttttaattttcaaaagaattgtttttgttctctgaatgttcctttcactagcacccttttcctatttagtagatgcaatattcttttctctctgaggatattaatgaaattttttttaaattttactttaagttctgggatacatgtgcagaatgcgcagttttgttgcataggtatacacatgccatggtggtttgctgcacctatcatcccatcttctatgttttaagccccgcatgcattaggtatttgtcctaatgctccccatccccttgccccccaccccccaacaggccccagtgtgtgtttttcccctccctgtgtccatgtgttctcattgttcaactcccacttatgaatgagaatatgcggtgtttggttttctgtccctgtgttagtttgctgagaatgatggcttccagcttcatctatgtccctgcaaaggacataagctcaatcatttttatggcttcatagttctccatggtgcacacgtgccacattttctttatccagtctatcattgatgggcatttgggttggttccacgtctttgctattgtaaatagtgctgcaataaacatatgtgtgcatgtgtctttatagtagaataatttattatcctttgagtatatacccagtaatgggattgttgggtcaaatggcagttctggttctagatccttgaggaattgccacactgtcttccacaatggttgaactagtttgcactcccaccaacagtgtaaaaacattcctattgctccacagcctcaccagaatctatggtttcctgactttttaataattaccattctgactggcatgagatggtatctcattgtggttttgatttgcatttctctgatgatcagtgatgatcttttttccatgttagttggccatataaatgtcttcttttgagaagtgtctgttcacatccttgcccactttttgatgtggttgttttttcttgtaaatttgtttaagttccttgtagattctggatattagacctttgtcagataggtagattgcaaaaatgttctcccattctgtaggttgcctgttcactctgatggaaaaacattccatgctcatggataggtagaatcaatatcgtgaaaatggccatacttcccaaagtaatttataaattcaatgttattcccatcaagctactattgactttcttcacagaattagaaaaaactactttaaatttcatatggaacaaaaaaggagcccgtatagccaagacaatcctaagcaaaaagtacaaagctgaggggatcacactccttgatttcaaactatactataaggctacagtaatcaaaacagcatggtactggtaccaaaacagatatgtagaccaatggaacagaacagaggcctcagaaataacaccacacatctgcaaccatctgatcttcaacaaacttgacaaaaacaagcaatggggaaaggattccctatttaacaaatgttgctgggaaaattggctagacatatgcagaaaaaagaaactggacccttccttacactttatacaaaaattaactgaagttggattaaagacttaaacataaaacccaaaaccataaaaaccctagaagaaaacttaggcaataccattcaggacacaagcacgggcaaatacttcataatgaaaacaccaaaagcaattgcaataaaagccaaaattgacaaatgggatctaattaaactaaacagcttctccacagcaaaagaaactagcatcagagtgaaattttattctttaaaattatcttatccttacaaattccgtttgtcctcccacactgctatttctgtttgtttgtttgtttgtttgtttgttttgttttgtttgacctccatcttccagtctggaggatttcctcggaaaatttctctctttggtttgtctgttcatccttaaatatgatgtattcaaaagctgattggaagctctatgggagtagttgggttttgtcgaatgtgggtgacatggtaatgtggtgacatgactggcctattcccttggggaacctttaatttaaacatccacagagaaggactatccaataacctgcctggaggtcacaagtctgagtgccattgctacaggagctaagtggaagaagaaatctgggagatgcggcatctcaaattttgtctataaatgttcacttaatcccctagttttcacacagtacttctaacctcaactatgcctggtgttctctggtcctgaagttccttgtcttatcctctccatagactgatccccagttgctgtttgagtctaggcaggacagtcaaatgctgcccataagggaggagatcacccttcatattgtcttatgcccaatttctgcctccaaagaaagaagtaaaaactaaaaggcagaaatgaaatccacaggcagatagccagatgcccaccctggtagttaaaaatcaagccctgacctaactgcttgtgttatctatagattccagacattgtatggaaaagcattgtgaaaaaccctgtcctgttctgttccattctaaatactgatgcatgcagcccccagtcacgtaccctctgcttgctcaattgatcacgaccctctcacgtggacccccttagagttgtaagcccttaaaagggataggaattgctcactcagggagctcagcttttgagatgccaagtctgctgaagctcctggccaaataaagctccttccttctttaacccagtgtctgaggagttttgtctgcggctcatcctgctacacacacagtgagggaggtggactggattccaaatgctttgtacacagaagttcacccaatccttctgcttttaaccctgtcctcaccccaattttcagggctcactattactaccagtcctaagcttttcagggtgctgctgggtggatcagattggttctcagctttcctccctgccagtttagaaattagatttcttaagttttctgagtcatttactgctttgcagtttctaaattgtgtttctgttgtcttatctcccattgtacttatccttttaggtttctgtctttaaaacatccactttcctcttatttcagaggagctttgggaaaaagcaaagagaagataatacatttccagatgcacaattccttttggagtagaaactctttcttctgtcttctctttgttcttttgttctctttgttcagtcactgattttcaagaaataaaatcatattcccattgtatagatagaacatattagggataggctttgcacggtggctcacgcctgtaatcccagcactttgagaggccaaggcaggcaaatcacttgagttcaagagtttgagacctgcctggccaacatggtgaaatcccatccctactaaaaatacaaaataattagctgggtttggtggcatgtgcctgtaaacccagctacttgggaggctgaggggagaagatcggttgaacctgggaggtagaggttgcagtgagctgagatggcaccactgcactccagcctgggtgatagggtgagattccgtcaaagaaagaaaaagaaagaaggaaagaaagaaagaaagaagaaagaaagaaaaaagaagaaagaaagaaagaaagaaagaaattagggataaataaataaactcacttttccaagatgacagagttggaggtggggcagtagctcagtatatccgtgttgaggaaaaagccaatgctgtaacactatgcagctgtcacacacttgacataagttactctagcctgcctgctcattgctttgcagttgacctctaccaatggcatggccaagtaataaaagccagagatagttgctgaatacaaaatgacctggctaaaacattcacatattactcttttttgcaaaagaaaaaagaaaaaaattgaactgatctgacctagcatttttcatgataataactatagttacctaaccaagctgaacgagccttggaattcatctgagaaaaattaccaatactaggttctggaaactggaagcacgataaatttctgagttggatcttttagagacaggataaaagctgaggtcatctaaaatttaatttagtgcctgaaagtaggtctcaaaatgaaaatgatgctttacccttttgaagcagaattttctgtatcctgtgtctctcgaaacaatttactgcatggatttctcttaggtcagcaggatggttagtccgagtttaagccaagcacaattcacagtcaatttctgctcagattcattacttttgcagctagctgtgagccttattgcatcagtaggagtcagactaatattgccagcagatcatgtcataatttgttaatgaaactattcattaccattttttgccatttctttatttgggatataatctgtatctcccttattaaaatgtgtcagatatgctgatgttctgtacaactcagttgtattctcctgactttatggatgaaatgaacctatataacaaacctgggattactctataagaatgcctctgagttaattatacttcctgttagcacaagtctattctaaaatgcacttaattgcatttgcagacatttattttgaagttggtcagcattggtggtttgtggctttgctctcaggaagaagggtgctacatttaaattaatcaataaagaataaatacacttgaaaaggagtttatgatttggtgttcttagagtgaagatgtgggaagagaagtcctgcaaatgtgaggagtcgattttacagaaaattgagtctcgggtaatttagtgactttctcccacaatgctcagttatttaatggtggagctaggagtaaccagttctcaggtgccccaggcccattccctttctactttactatgggagtaggatcttgcagaaaaattttctcaatgtaatttacttttcataaaataataataattaatgatttggtatttttaaattttttgtttagaaataatttaaaacttgcaaaatagttgcatatacaatacacatgactttctgtagtttgcctaagacatttaatttattaattattttgaaaacagttaagataaatacctaaatttcttacacttcatttgtagattggataagtttttattaattataataatatttaagtgtatataaatataaatataggtcttctattaagttgagccataatcttaacatatattatttataaatttggttcttataaactttagacaatattccatgtatttggattgatagtttcaccacttacaccaactgcgtacagttttatgatgtcctcatttctgtcaaagtgttattataaagtataatacacataactttctacgtttagatagatcaatttttaacattttacaattgtatgtcacagacacacaaacacacactgaaatacctgaatgaagagacagacagatgcagctaacttcatatatttcccaagaacaagaattctgggacaggcaccatggctcacacttgtaatcccagcactttgggaggccaaggcaagaggatctcttcagcttaggagttgaaggttacagtggcctatgaccaagccaatgtaaggcagcctgggtgacagagcaagaccctgtctctaaaaatattaaaagaaaagcaaacaaaagaaaaaaattctcttacaaaaccatagtacatgtatccaattccagaaatttaacattgataccatgctctttattatataatatacagtccatattcagttttcacagttgttgcaacaatgtttttctggtcattctgttctttttcctcctaaatctaatccatgttaatgtgttgcacttagttgtcacgtctctctggcctcctttaatatggactagttctcagtctttctttgtgtttcatgacatggacattcttgaaaaacacaggcctgctgttttgtaaaatatctctcagtttgagtttgtctgatgtttcctcatgattacagttggtttaggtactcttctggcagaaatactacttaaatggctgtgtgtcctgttaaagcatcacaacaagaggcacatgatgttagtttgtccattattggtaataaatctttgacatttggttaagcaaggggaggggggtcttccaggtttcttagcaggttattttcagcacagcatgagaagcaagaaagtctacatggcaggaagtacctaaaatccatttgtgagctaaactagatggaatgctggcattaactagagttagatggggttctttgcagtgccagccagtgtgattcagccctcagcttgtactattctccaggcctccttcttctgccaaaccctacggcctgattcaatgacaatctttgatggggcctgctgagtcactttcttaggagccaatgctatgtaggtattccttcctctacaggaattcagaaagtatcatcccaaaatctaaaaacacatgagttggatgacactatggtctgtatatcctgagtcctttattgatcggttgcagagatgtttgactgataaacctggctttaattgagcttacttatgtaataggccacaataatagcccaaggaatatatttcccaaggcactaaccatagtaacagggaccccttcccctgccccatttccttcccctgtcctgtgctgaggtaattggctgaatagaacagagcttgagctgggcacaggggctcatgcttataatcccagcactttgggaggctgaggcaggtagacagcttgagctcaggagtttgaggccagccggggcaacatggcgagaccctgtctctactaaaattacaaaaaattagccagatgtggtggtgcatgcctgtggtcccaactattcaggaggctgaggtgggaggctcacttgagcccagtcgggtgaagattgtagtgagttgagattgccccactacactccagcctgagtcacagagccaggctctttcttaaaaaagaaaaaaaaaatcgagaatagaactcgaaaaacacagttgcagttgttttcctcagggagccatctcactctaatgaaggttctacctgctacccacccttatcccctgcctttccccttactaagctgggataatgttaaacattttttacttggcagaaatattcattcttgattacaaatcactgggttgtgtgagaaaggtgaagtcatataaaactatgggccttcaaagaggatactccaccctctttgggggctgattagaaactaacatgaatcaaataaaacaaaatgaatgaagtagctctctgtagaaatgtttacaggcccaacttccaaacttcacagttatttaatcatggattgctattgggactagagcttctcccacattttagaatgttatagttaaaaaagagtgttacaaatgatcaacctgctagctgcctcagtttcttcattacaaatgagaataacctgatctaaagagacatgtttggagcaagcttgaatttatttggccttctggtcaagtcaagcaggtttagcttggaagaaactgaatcacacataaactagaagtggggttgctcatggatatgagactgtgccttgggagttggtaatagagaggggttgttttctcaaagcctttttggagaaagtcaccataggagttccttgttcttcaccccaaatctccatagtttctgcaactccactaaattccacatgtctgctcctttctgttttctcaccctcactctaacttttaatttccccaaaaactctggtaagagcgggggtagtaccttagcttgagttctcccaaaagatgatcctgggagaagggtttggatacaagcagtttatttggggggtgtcttagtttgggctgctaaaacagattaccatagactgggtagctgaaagaaaaataatatttttttcactattttgaaagccagcagtctgaaatcaggatgccagcatggttgggtgctggtgagagctctctttctggtttgaaaatggtagtcttttcacagtatcctcatatggtggagagcagagaaagaggaaaacaacctctctcgtgtcttctcagtgcattaatcacataatgagggctccgccctagtgacctgattaccttccaaaggcctcatctccaaataccatcatactgaagattagtgtttcaacatataaattttgaggggatacaaacattcagtgcatggcaaggagtaataccaggaagcatagaggggaaaaaagagaaaggggaagacattcaataaaaggcacattcatgagtgagttattacgagggagctcaatccactagggacctgctgagaggctttgctatctctcatgctgctaatcatgagacatcatgccctagaattatccctccaagagaaggaaggaaattggagaggtacccaccaaattctgttcttcatttgtgaaagtcacttctaggtcattaaattgcctggcccttcctggcttgccccacaagtgagtgtagcatactcttatagccagagaatgtcctaagtcacagaaatacaggtacttaaggtaagaagcctctggtagtataggaacaagtaactgtccacggaagttgcacatgatctcctggataagctgagaggttacagatggggcaacaacaatgagtgacactatggggaaggcacctgaggcaagctgggccaggcagctggtagggaaggttggagtgccctaggccaacacttcagcaaaaactgtatgcacagtgattcccaaagacaggaattgtgaaaggactggtacggtaaaaccggtctgctagtaaaaccggtctgctaggtgtttccgaacaacctgtgtaggaccaaccaacccccccgcaacacacacacactgagcatacatacacacactaaaattctaggaaagcctcatgctcacggtccatacattctatccttacatcttcaaggaagcaataagtccatcagcagaagtaattattgcaatagtgtctttattaatagaattctgtctgtcactctgctcagttttcattactttttaagatcatgctttggatgaattttttaaatgacttcataagaatagagcagaacaaataccccatgtggcttttggaaaatcattcaagtcttctaaattacataaaagaatttaaaaatattcaacccctattcatgctggggtggaaaggataaataaagcagccctttttatttccctccagagtcaaaaactaattgagacataaaacacaggaataaaacagagataaaaaatcacctttgtcgaattaagattgaattgcagaatgagactagatatgtagtcataatgggccccccaaaaccatgcccctaacaatatacccaagaatccagcctcccactcatagcagaaaaacattccctaagacatgcagcacatggagattgtaagagtgtttgaatcttctgtacaaattataagagagagacagagagacagaaaaagagaagtagagctgtagagccacactgtattatttgggtctttttggaagcagactctgagacagagttagtagtgcaaacagtatatgtggaggtaaatcttatgaaagatgaaagggggaggaagcaaaactgggcagggaaagtcttagaccatgctgtggctatgacacctatgaaaggaaagaggtgagaaagcaagattgagcgaaggggagaaagtaagtttgggcagggcaagcctgggatctcaatgcagatttgacaaagtctcagtcaacacctagggcagctccaaagcaaataattcctgttaattgagtcccatattggcagaaacggtcaggccttagcatttcttctgtgtttcctcattggctaggcttcccgagaagaatgtggccttcaaaagttggaggctgtcaactagctgcactccttgcaactgagtggcaaattctttcctgagaggttctgcaagtgccacacctgaatggctgccatacacatctactttgttccttttcttactgtttctgatcagaaaagttgtgcttcttcactactggaaaggaatagacaaaggagcagagagaggctggcagtgttaccaacatgtgtttagttctcagggaatgaagtggaaacatacatacacacaaaaatacatattaagtagaagtcctttatggatacatgaggcatatgaaataattcgcgtcccttaccccttgccacaaataacacataatcccacttctcttctaaggcaggtgggtcctattaactggagaaccctttatgttgatgagctggagagctaagtggggctcaactgcatatcacaatggaagagaaaagaagtgaggggaaggatgaagagaatggagcctataacggtgagcattgtatgaaggacagagagaaaatcgttgtatcaggaaggccaagaagggacttgggagaatataaatgtcaattgaaatttttaagttgattgctttgaggaaaatgatgtgaactctttcttggcctctactgtgaaatgttaagaaagtctacattgtcctgaaatgcttttgtgaaagtggatttttcacaggatgcccaggaaggtattgacatttatgtctgaatgaatatgccatgcagcaaagccaagtggctgagatagtaatctaccttgggtctgcatggtgccaaagcccatgagctcaactgttaggcttagactgctgttggttggcacaaagttaatggaacagcctaagaactttgccctggacatgccagcattgtggagttcctcatttatggggttgtgttccaaaactagggtgtgtcctcagagagtgtgtacacactcttgttttccatagttactcccacaggccagcctttggctgcctctagcaataaatatggcaagagagcacagatagtacactgaatcgccaaggccaaataagagtggggtgaggtttggtccactttcagtcccaagccccatgattcccaaatattaaaaaagatattagtaaacaaaatataaaacaatttgaaaaagctatattcatgacaattctaatatgttctatcttgggattataccaactatggttaagggaaactatttcacaaaatggattaactgttaaaaatatgtgttaatgcctatccaatatcatggagaggaaggttggttggatttacaggagcagttctatttattcagaaaaaaaatcctgtaatagaaaatttactcagtaagctgtgctaccttatgaatatcatttgggagaaaacaagtctaacagatgctgttggtgccctccctccatagccccttggcatttaccatgttcatacatgctgtccaacttccagctgccagcacctacaaccctcagcctgaagcctttctttggacactggagatctttctgatcctccccacaagcaacccccaaccaattatggatcgagttactggataaatatcccagctcccttgtgccatgactggtataaatcagaggcacgttctcccagggagattatgttctccttgactttggtgatcttgcttaataatgcaaattttattggcttctttccattccttgtttttatttctctatttccttaatgatagttgctgggattatctgccaaataaattacttacatttaaaccattgcctcagagtcttcattttgcattaccatacaggactacccgagactgggtaatttataaagcaaagaggtttacttggctcatcactctgcagagtgtacaaacatggggccagcatattcatggtttcagttgaggcctccggaagcttctactttttggcagattgcaaagggggaggaggcatgtcacatggtgagaaaaggaacaagagagagaggagaaggtaagaggctcctttaaacaaccacctctcccatgaactaatagagcaagaactcactcattaccatggggaggaccccaagccattcatgagggatccacctccatgacccaaacacttccaccaggccccacctctaacattgcatatcacatttcaacatgagatttggaggggacaaatacccaaaccatatcagggtcacttctgtaagaacacaaaccaaaacatttcatttgcctcacctgttgcttactaaacaaacttctgatttgaagttgagcttctctagtggccaatttctgatgaaagatgcagtaataatgtgtcccgcttatatgagtcctattggtggctgattaatgacttggaaatattgttggtgtgagtcagtcttctagaacagggaatggcaaactatagcctgtaggctaaatctggccggcctttaaattttgtaaataaagttttattggaacacagccacatctacatatagtctgtggctactttcacaccacagcaccagagttaaatagttgtgacaaagacaatatggcctgtagattgtaaaatattatactttatagaaaaagtctgctgatcactcacggagaagctgttcacctttgggttcactgagaaagtcaaacctgtagatttataaatatgagggtcagaacttggaccaatggcatctcaccaagtggcagcccagtgagactctcaacttaaaatatagactggtcaccacctactcaattccttccagtgtttgattatggcatggtcagaattctaggaattcttgtccatgtcttgggaattctagggtagagaacagaaggagggcattggctagacgggaatattaagaaagtgtcttttaaattgaggttcatcaacacactttaagcaaacttctctccagaaaacttcttttttttattgacctagttcttgctaatcatcccctcatgctgtaccctcttggtccttacaggcttagcatcaattattaattaatttgaaattgatcgatgaggtcctctgtagattattctaagctatgccacaattctagctagctcaagcttcttcagcatagagactatttatattgtcaacatcctagcccccaacaattgatagcatagtattttgtatacagcaaatgttcagtaaattattagactgtccaacatccaccacacacagacttctatagatgagacaaaatgataatcaaactggaatcatttgtcaaatatgaaataattttacataatgtctctagagtgataaggaatgtaggcttcaaaaatgctaaagaaatgtatgaaatccctagccttggccatgcagtgttatttttgacattgaagtggaagaaattgctaagtcacaaatttcaaaagcgaccccttcctgagtaagtaataacaaagctaacaaagaaagaaagaatatatgtgacccatttgggaaattaaccagattgcatgaactttatgtcttgtaaaaaatccttctgagtaaagactaattactaaaaatatatttttgttcagttatccacaatctagttggtggataaaacaggtaggccaataataatattccaaggaacatttagacattggaaagaataaccttgcactataataactagttccactacctcacttctactcattctttaatccactgtgatctgacttttattttcaattaagttcaacttatcatttttaatttcctgtttatatatatactagggcttaatgagagaaaaaattcctgcatttcctgcactccagtgttctacagcctattaaaagatccaggcatatgaagaaacaattgccatacagagtggcaagtgccattaacaagaaatgtagtataaatggaggtaagacaaaggagaaggtgatcagctgtgtttgagggtggctcttaggttggctggtcaagtcaagtcactgccttgacatttgggggcatttattctactttatatttattctactttatattcaatatcacaaatttgaccttcagctttgaccttatgtttttcagtccttcttttgagctgtttttttaaccagctttaatggaagaaatggtacaattgaagggcaatatgcaggaagtcaccccgtatctgtggggaaggcagcctaaggctcagcctattatccgtgtcactcagggtgagcttgccaaagaggtactctgccatactgtcccccagagcccccagcttgctgcccagaagcaagaatacttagcacttgcatgttttaaaaagataacttttcatgtcaagttaaagactgtattatttttatccctgcccaatctcattcccttccttcccttcttctccagaggcaaacgctaggatgaattccataccatgttttacaccgtaccatgcatacggacccacagataccatggcccaacacagcacaccccacccgaacccacccaccccacacatctcaccccaccgtaccccacctcaccccaccccatcccacacgccctcagagtttataaggggaagactaatgtattttccaggggcccataaaatacctttcccctccacccccgcagatcctgagctgcatgcagatggggcagagctgaatggaaagactgctgaatacctactttaaatctgcatggggatgtgccctgattcctaaaaggtgagagtgctgcagacacacatcggctggacacctttattgctttgagaacagataactttattgttaacaatggtcaaactgagaggagaaaaatgaagagaatgttctgaaaaggcaacatggacgtcccgcctggtggcgcgagcaggggaaggcaccccatggctgaggggcctgtctgggctcaggtgtgtttctggctgcggcccagggtgagcttgttaaagaggtactctgccaggcctgcttccggggaccccatcttgcgcaggttgctcaggtagccacccagctctttgatggtcttggcctgctggttcaggaagtggttctccaggaagtcgcaaagctgggggtcgccgttctccttggccagctggtgcagctccaggaggctctggttgatgttcttctccaggtggaaggcgcactccatggccttgagcccgctctcccagccttggccctctggcttcccgacgtcatgaaggcagatgcggccaccgcgcaggttgtgcagcctcatcagctcctgggcgtgctcccttttctcctgcaactggcacaggaagtagcagtcaaagtgctccagggccgcgtcgtcctggtcgaagtagaaggccatggacaggtacacataggatgcgtggagctccaggctgatgtgggtgttgatggcagcctcacagctggggtggtggtaccgttgcacctgcgacagcgggcccagggcgggcagcgcgggcgctgggaggaggggaaaagcagtgggtttgccaggggcccggagcgggtagcggcatcggcgtgggcagtggcggcagcggtggggtcctcggagcaccaccatggtggacgacagcggcggctggtggagggcggggtcctccgggcccggcggtagtgtggtcgctgattctgtgaagggaccagaagtgggcggtggagaccgttatggggggaggggcgcacgaggtcgggcgggtgtgggctggtgcggagccatgcgggacttccgacaggtgggggtgggggagcacgctgagttccatcggcagcccggggaactgggcgctatcagacctctgcgctacgtcaattctgcagtaacttttctagtgtgcaaggacttttgcctgtcccctgattgttcccctctatgacagcttgttctcattttataaacctcttgtctttcttaaactctgagagtatgttctggtaacgttttcttctgtttcctgtattatatcctttttttccctcctctagaattagttctatttgtgcatcttcctcactttccttaaatatctggaaaacgtttgtctattcatgattggaatcaaggactgggttagcctcagtgataagcatggatcgaatgcacagctgtgagtctgggtgaccagtaggattctcccatgaacaggagggtggagtgtgttaattagggagtgctcatctcctttggagataaaggtatagagctcccaggcagagtaggaactattctaaatgcccaaagcatggcatttctctggcactggaaaactttagtggatctgtcttctaggtagatgtcaacttccctttaaatgctcacccatgtctgctgcaccctgaagcttaattctttctgcaggagagatgactccacatgataaggaatgtgatttcagatatgttttcaggatcaaagcttaaacaccagagtaaagactctgtttttaaaatttatctcgaaaagccctctatgttcacagttttaggtactcaataactaatccctgtgtcttccctgctgaatttgaaaccaattagtagacacaggactcagctcactgaagagcaagcttacgtctgtagcaaaatgaacttgctagtacttttcaaatcttccaattagagaaactcactgtggcagaatgacttcatcaaaacttatttgttttcatcttgatccacaggtaaccatacgttttgagctacccttgtgatttgatggggtcttgtactgatttctggctattggaatatgaaaataactggtgtatggccaaataaggcctagtttataggacacaccctgtgcaatccatgtctcaagtgaagaagaggaacagaccctacaatatgacatatccactttggagaaggagcctggaactttggataacatatggacaatgtcccctcatcactgtcaccaccaacctgcactggaccttgataaaaacagaaaaataaaaatttactttaaaagctaaaaagatttggaacatttgttacaggagatagcctctcctgactaatcaaattagctagtcaaagaaggtactggataaccacaggctgttatccagtcctgtagggtcctatagacttatggcaatggagtgcattccagaacacaccctgtcagtgggaaggcagatgaggaaaaggagaggtttagatagctctgggtcatcacactttcttccttttgcttactacactatacacacacacacacacacacacgcatatctcaatcactctcctttttttccttctggagagtgaaatgtaaaatccctcattggccagtgtggcaggttacctctgtaatctcagcactttgggaggccaaggcaggcagattgctggaacccaggagttcaagtccagcctgggcaacatggcaaaatccactctctacaaaaaaaaaaaaaaaaagaaagaaaaaaaaccacaaaaaattaggcatggtggcacacacctatagtcccagctactcaggaaactgaggtggaagaattgcctgagcccaagaagtcgaggctgcagtgagccgtgatcccaccactgcattccagcctgggcgacaggagtgagagacttggtctccaaaaggaaaagaaaaaagaaaaatccctcatggactcttgaggatcaaggaaaaatgttttccttctgcctcgatgtcctggaataaaatcaggctggtccttgggtacctaaacttaagccaggaacacaaagcacaggggcagagatcacgactgtctgacctcagaaccagtcagctgtagtgaggaaggtgggacatgtaatgatataaagctctcctggaaccgcatacctgcaatctgtgtttgggtggagcacttccccagacaaggggagtgatagttccaggactggtggtggaaggctaaccaggtggtaccacagatagtaccattcagtcttccctactaagccatgaaatctgcagagttaggaggttcccacatctgtctttgcttcccacactacaccatgccagcgcttagcacattcttctcctttggaaaggagtatagtgaggaagaagcaacaaaagtgggctaggaaagcaaaagaacaaattgttgaaggtatctgtgggagtgaaagtggcgccaactcccaactactaatgtgaaatgcctttgggcagcatgctgcctcaatgctctgtgtgaggcccagggttcaggggcatggccacaatgagcactggttaataaaggtgtctaggaagccagtctaagctctttcaccagagaagtagatgatttaatgagtccgtaccagactagatgatttccaaaatccttgggaatcctcactattttgtgcggtaggaattgtttttgttattgtacccatgagaaatctgttatcctaaatataaagcccttgcccaagacgatacagaattcaagaattcactgtcagggctgatgctcaactagaactctgggaccacagtcaagttttcaatgaaatgctgtataattaggttgctgggtcatataatttctcatggcctctctctgctttagtgagaacaaagacatgtagagagaaccagtaagtagctgctgtgattccacagcaacataaactaccgccctctcttgccaagtgttcctgggacagccctttcttctggcaaggtcaagtttctcctatgcaacttcacagaacaaataccccttgttcaatttctactgggaaatgagtttaagtaaattgtttttaaaaatgtgaggctatagtatgagatagaacacagcttttcctcaggaggctgccaagcctctcttcatggatgggatgaggagtttaggctttttatctctcccctgatgtgctgatccctactttaggattgtgattaatttaaatactgtgtgtctacattttaggtgacatttctttataaagtgttggtcccccacccttgtgcaatggggataatctgcattgaactataagagtacagctgatgcttggattgcctttcctggtaggattaaaatacattttatttagcaccctactccttctccaaaactcttgttccttggtcaattttctgaataactggtgctatctgtgtctgattatttctaacttgactgtaattatgtgacttctcatgaagatgttcttccttcctccatctcttaacaatttgctgcacagaaatcccaaaaaattatttactggttatagacacctctttggcttatgtagaccagcaattctcaaacgcaatccataagtctccccactgaatttttgagtctgttggtgcagggtgggggtgatatgaaagacaattttcagggtccacattcttcatttaatgttcagcaagagaatcagcttcatttcatccagaaactagcacacagagcaatgggaatcatcactgatcctaaatgctctcctgatagttattttatgattgagtccatgtgcttcaaaactcaaatgctttcattgcatgttttattctagaaggatttcaaatggatgactctgtcactcatggtaggtgacagtgaccctttcatggagagttctagtctagcagtggccctagtgcctctttactgcttctcaaatcacccattttatccaatgaagagtgtggaagaggagtgatatggtttggttctgtgtccccaccgaaatctaatctcaaattgtactccccacatgttgagggagagacacggtgggagtgattggatcatgggagcagtttcccccattctgttctcgtgataatgagggagttctcacaagatctgatggttgtaaaagtgacagtttcacttgcactttctctctctcctgctcatgtaagatgtgccctgtttcccctttgccttctgccatgattttgtttcctgaggcgtccccagccatgcagaactgtgagtcaattaaacctcttttgtttataaattactcattctcaggtagtatctttatagcagtgtgagaatggactaatatagattactggtactgtcagagtggggtactgctataaagatatcctgaaaatgtggaagcaactttggaactgggtaacaggcagaggttggaacactttggagggctcagaagaagacaggaagatgttggaaagtttggaactgcctagagacttgttgaatggtcttgatcaaaatgctgatagtgatatggacaatgaagtccaggctgaggtagaaaagaaaattgcattttctggagagaaattcaagctggctgcacaaatttggatacgtaacaaggagccacatgttaatagccaagacaatgaggaaaatgtctccagtgcatgtcagagatcttcacaacagcccctcccatcataggcctagaggcctaaaggggaaaaatggtttcatgagcagggcccagggccctgcttctctgtgcagcctcagagcatggtgcccttcattccagctgattcagttccagctgtggctaaaagaggtcaaggtacagctcaggcagttgcttcagacagtgcaagccccaagccttggtggcttcaacgtggtgttgggcctgcgggagcacagaagacaagagttgagctttgggagcctctgcctaaacttcagaggatgtatggaaatgactggatgtccaggcagaagtctgcaaggctgctgcaggggtgaatccctcttgaagaactctactgaggcaatacaaaggggaaatgtgggtttggagcctgcacacagagtccccactggtgcactgcctagtggagcagtgagaagagggccaccatcgtccagaccttggaagggtagatccatcatcagcttgtactgtgcacctggaaaagctgcaggcactcaatgccagcctatgaaaacagctgcggagctgtgccctgcagagccacaggggcagagctgcccaagagcatggaagcccactccttgcatcggcatgctctggatgtgagacatggtgtcaaaggagattttggagctttaagatttaatgactgcctgggcaggttttggacttgcatggggcctctggcctctttgttttggccaatttttttccacttgcatgggaaaatttacccaatgcttgcactcccattgtgtcttgaaaataactagcttccttttgattttacaggctcttaggcgaaaggcacttgccttgtctcagatgagacttcggggttggactttcgagtaaatgctggaaagagttaagattttggtggaccattgggaaggcatggttggttttgcaatgtgaaaaggacatgagatttgggaggttccaggggcccggtgatgtggtttggctctgtgtccttccccaaatctcatctcaaattgtaattcccccgtgttgagggagggacctggtgggagtgattggctcctgggggcagtttccccaatgcagttctcatgatagtgaaggagttctcatgaaatctgacggttttaaaagtggcagtttcccctgcactctctctctcctgctgtgtgtaagatgtgccttgcttccccttcagcttacaccatgattgtaagtttcctggagcctcccaagccatgcagaactgtgagtcaattaaacctcttttgtttataaattacccagtctcaggtagtgtctttatagcagtgttagaatggactaatacaaacagccacaggaggaaactgagcagcagacatcttggtggtggagcttgctctccataaacatgccacaccttttttacatcctctaaggcagggattggtcactaaaataatagatggaacaagggtatcctccaaagacataagggtacaatgtgaatttttaagaggaaaaatattgccaatttcttgtaacctttgactgtcaaattatacatggcatatgacccaatctttgggctgtacactctggtagagagaggatgtgggcagcaaggcattttcagagttattgcaggtaggttgcaaatccatattttcactgagccttgtctgaggtctgaatgatggctcacaattaactgctattttcataagcatatagatgctcttgtgatgaagaacatacaaatttatttaaaaattccttgcagacagctacccatacattgttggtctaccctggggtcagctggagagagttcctgcactctctgctcaagggttttctctgtcccacaagggaataatgctcataccttggaggtcaaccctcaagagaagagtaacagaagtttccacgtcaatactccaggttctttgccttggatgggacacttctgaggtgtgtgcctgactcattctatggctctccagtggtactgagccccagtttctcgcagcagccatctggttgcctattgcttgttcttacaaatgttatgtcctgtgttatcatgacagtgattaacaatacataattttgagcagatgggatgataggctctaaatagtgtgtaaaggatgagataatcaagggcatgtatgaaagtacatctttcaagggtctttggacccacatgctaaaagtgagtcacattactgattaatataccagatgccaagtatcaactgcacccacccgcctgccatcaatcatcaccatcaagaagtgccacagaattcaaacttctggtctggggctttcacaggaaaatgtgacatgactgaatcttcacagagaggagaagagaggaaggggatggtgctgataatggttgagggcctgagttatattgtctctggggagggaacagatacttacatgggagaaaagatcttgagggtatagagaagcatatcacattttatcagttgggtctgtcaattatgtttacagttaagaaacaaacacatttcctagactctttcattttaataaataggctttcaattatattttgttatttccaaactcagtgttaatttttttactcattgatactggtaaacctgtggctttgtagaacatggtaaggattaagtggccatcaacctcatcttagattggttgttttagaaaagaaaagcttgtaaagttacatcttcttttctaagtgggctgggaatcattgcttctcatctgtttctggagtcttaattgccagaagcagcgttatgaataaagttaaccttggaaaataaatttgaatccttttttatattgtcagttaacaattcaaagaattggaaaaacatgttttctttatacaaaacaaatctacatattttcttagtttctccaactctctctggaagctgtttttgtgtgcaataaaatatttatgcatttttgtgttgatgtattatcttatcaggagtggtaaatatttccttaaggttaagtcattcaacaaagatgatatttaaatattggaaaaagttacgagggaagccactggcatctattttaaatatagtataagataaactcacttcttttgaaagctattagtgtgaggaagaataaactaaaattaattctcagtttattttggctagtagtacaaaaaagacttactgaatttaaaacttcatattaaactcagtaacaaatgtaaaacatctataagcaatggtttttgcaatacttgagtgttgaaactatgtttgtgtataatgatcttctgtgttttacctaaattacattttaggaacatgaattgtttcttaattatgaaaatttcaaaacatataataaattcccatgtttccttctcacagcttcaacaattactaactcaggtcgatctttctccccttctacctgatatattattttgaagaaaatctagaacattgtatcatttcattcataaatatttcatgacacatttctcaaagtgagaatttttatagtaaaaattatcatgctgcttttttttcaaattatgaatttgtgatcataaaggcaaaacaatcactttcaaaggtgaaaactttgctgttagaaagagtgtcaggccaggcctgtaaccctagcactttgggaggccgaggcgggcggatcatctgaggtcaggagttcgagaccagcctggccaacatggtgaaaccccatctctaataaaaatacaaatacaaaaattagccaggagtggtatcgtgcacctgcgcctgtaatcccagctaccttggaggctaaggcaggagaatcgctggaacccaggaggcagaggatgcagtgagctgagattgtgccactgcactccagcctgagcgacagagtgagactccgtctcaaaaaaaaaaaaaaaaacaagaagaggaaaagaaagaaagtgtttgtattttattctgggtagatggtttttgttgagagaatgctttatgtcaactagcagttatgtgagacacagctttaaagagcaaagcactgcattcagcagaagatcacaagctatgctttcttccattttgattagaaaaataaaatggcagaattacatacaagacaacatggaactactaaagtactttttcaagttgcttttatgtttgatttgttaaggaaaaacaaaaagaacttgaagattccctttgtaaatatgaagaaggtgacttgtgaaactaatctagccataaattgatcccaggaatactggttcttcggagattcctattgctgttccaagagtacaagttctatatcaaggagtgcttcctaatggttatggatttgtgaaaaatgtaccataaaaagttcagctctttatttttcatgaaatgggtatcctatggcatactttctagaaatatcatgattgtcaatgctatttagtcattatacttaagtatttgatacttttttttctacatgaagtttatggatatattaagtttgaaccctatgaaattcctaatttgtcagtttatttttcggcagtaaagtccctttagcatttcctgcagagcaagtgtactagtgaggatcgctgttgaaatttgtttatcttgggatgacttattttttgatttctttgaaggatacattgtggaatgtagaattcttcatcagcagtatttttctttcagcacattgaatatgtcatcttcctacctctaggcctctggtatagtttgaatatatgtccctgcaaaatctcactaacctgtgccccagtaacctgtgcagcctcaggacactgctccctgcatccaggctgcaccagctccagcctcagctcagatgaccccagacacaactccagatgctacttcagagggtgcaagtcataagccttggtgacttccacatggcattaagcatgtaggtgtgcagagtgcaagactgaaggatgcttggcagcctccacctagaattcagaggatgaatggaaaagcctgagtgtccaggcagaagtctgctgcagtggcacggcagtgcggaggggagatgtgacataggagcccacacacagagtacccgctgggacactgcctagtggatctatggaaagggcacaccatcttccacaccccagaatggtagagccacaggcagcttgaaccttgtgcctggaaaagccacaggcacataacaagctgtgaaagcaaccatgggtcctgaatcctgcaaagctacaggagtggagctgccaaaggccataggagcccatcccctgcaccactgtgccctggatgcacagtatatagtataaggagactattttgaagctctaagatttaatgagttccctgctgggttttgaacttgcatggggcctgtaggccctttcctttggccgatttctccattttggaatgggagtgcttacacaatgcttataccgtcattatatcttggaagtaaataacttgttttgattttgcaagctcataggaggaaggagatgagtctcaaataagattttggactttcatttgggacttttaattgagttgatatcagctggaaggagttaagactttgggagcctgttggaagttatgattgtattttgcaatgtaagaagaaaataagatttgaggggccaggggcagaatgatatagcttaaatatatgtccccaccaaatctcatgttgaattataattcccagaggtacatgtgggacctggtggggggtgttttggtcatgggggtggatccctcatggcttgcttctgtccttgcaatagtgagtgagttctcatgagatctcattgttgtaaagtgtgatgcctcccccaaccctctcttgcaccttttctggccatatgacctgcctacttccagtttgtcttctgccatgagctaaaggtccctgaggcctctccagaagccaaacagaagccagtgccatccttgtccagtctgcagaaccatcagccaattaaacatctttttaaataaattacccagcctctgatatccctttatagcaatgaaaacagactaatacagcttccagactttctgttgagaaatcagctgttaatattattgatcatcctgtgtatgtgaagtgtaacttctattttgccgctttcagggttttttcattgtcttgtcttttttaccttttgtttatagtgtcttggtggggatatctctgatttttccctacatggaatctattggatgtgtaaatcaacatatttcattatatttaataagatattgactgttctttcctcaaatattctttatatcccttcatattcccctttttatctctttccagaactccctttatgtatgttttggtacactggatggtttccacaagtactctgagcttcgttaattttacttcattcttttttttcttccagattctcagactagataatctcaactgacctttcttggagattgatgattctctctacttcttattcaaatttgctattgactccctctactgaaattttcattccaattgttatccttttccattccagaatttctattttgttccttttttatcatttctattttcttattggtattatgtatttgatgagacatcattctcatggttttcttttcttctttctaaatgatgttctttaatatttcaaaaagttgatttaaaatatttgcttagtaaatccactgactggatctcctctgagacagtttctattgatttcttctttctcatgtatgggcaatactttttgtttcctgatatgatttatattcttttgttgaaaactggacatgtttaacattattaagtggcaattctagaaatcatattctccctcagcccatctgctattatctaaatgccctccaaaatgtagtgttgaaacttaatggccaatgtggtagtattaagagatgaggcctttaggatgttactaagtggtgagggtagattcgtcatcactggtactagtgacctttaaaaagcactggagggaactaatcctttgattcttccatctttctgctatgtgaagacatagagttcatcccttttatcattttttgctccttctgccatgagaggacacagcaagaagacccttactagatgcctaattctggagccttgatcttggccttcccagcctctacaaatataggaaatacatttctggttttcataaattatctgctctgtggaagtttgatatagcagcatgaacagactgagactccaacgcttgtttttgttatttgttccagttgttgtttgctggtttagtgactttgttgaactcattttgtaacatctgtattctttgtcatgtgtggccactgacatctcattcctgttattgtagtggtcagcttgtgaattaaaagagttcttatctagaacgacccctcctcaccaaaacaaaacgaaacaagaaacaatctcctagttttcacagatggtctctttgtgcatattagaacacactttcctttggaaggccaacgtgggcggatcacaaggtcaggagttggagaccagcctggccaatatggcaaaaccccatctctactaaaaatacaaaaaaaattagccagatgtggtggtgggcgtctgtaatcccagctactcgggaggcagaggcaggagaatcacttgaaccctggatgcagaggttgcagtgagtggggatcctgccactgcactccagcctgggtgataagagcgaaactctgtcaccacccaccccgcccgcaaaaacaaacaaacaaagaaaaaacacaaaagaaaacaaaaacaaacaaacaaaaacactttcaattttcaacttggcagtatacagcacagccataactttcacttcctgcttgagggtaacctgaagcgcccatcacagctgggtgttaactcaccaaaccaaaaagctaggtgtgcccagtggtacaaggtgcggggtgctgtgaattaagcaactgtctgggtgaggggggagggtatatatccatgtatgctgataactccgtaaaataaatgtatataaggatatacagaaacctcccccccaaaaaacagggacagggagaagccttcataatatacccttttatatgttttatttctgaacattgtggatatattacttctcccaacacttaaagaaattcattactcctgggaagtcaacaagaacaggtaaccttttctagaatactggctatgaattacagcatgagatagcagccagttagagatgcagacaaggtttatggaattgtgtgtttagtgaacatggagagtgaaattgatcattaagggctggatgcaacagagagaacacggactctgagtctgaacacctggaagggtcatgtacacacacacagacacacacacacacacacaaaacgcacaaacctgccatttatttattaaaaagatacgaagagaccaattccacaggtctgttgcttaaataaagtctcctatggcatgtggaacaaggaattgagatgacagcagaacagaaatgatgcaaagacattacctctttctgaagccaggtgattctgactctatcatctactaactataaggtttcagatagtgacactactctgaaaccattttctcgatgtaaaataggggagatccacgtctcacagggttgttgtgagaaggacacaggcaatgtctggaaagcacctgaaatggtacctaacgtaacatgcgcttgacaaatacttgctatgtaaaagcagggagaaagatgcatttatttttttcttttctgaaactttattgcagtatacatgacaaaaattatatatatatattcaaggtatataatgtgatgtgttgatatgtgtatgccttgtaaatgattaccaaaatcaacccaattagcatatccattacctcacatagttgctttttagtggtgagaacacttaacatatactctcctaactttctaggacagaatacattattattaactatagtcatcatgctgtacattggttcttcagaactttttcaacttacaacatgtgtgtaccctttgagcagaaaaatgccttctccttacagtctttttatatcagatgaatcataacaaatagaatatctacaaagtagcttaagtagcaaggttaactgctgttatttatcaggaaccctggggcatattaaatgtcagagtttatacttctgactcagttatgacagggctctacactgggttctgcaactcccttggccttgtcctcatggataccaagtggctgtttctgcacaaagatcacatctccataccagcattcaatcagcatgacaaggatgaggtgaaattattattttcacaaagtgctgtcatttatcaggcaagtaaaattttattagaaatccatgttatttccatttatgtatttggtgagaactcattcatctggcaaactctagcagcaggaaatactaggaaaacaaatatcttgaaagagaaaaaaattttaatgattcattttgactagttattatttatcccaagacactgtcaacaccatgactcttaaaacttcagtgttctcttactaaggaagaaagtatagaatggcttttgtatcagtgtctgatagtgtctgtcataatctcttttctgagataattgattaagtcatgagtatattagattagataattcaggcaattgctttctgccaaagagtagtggtggtagaaaatgtatgagaaagctgcaataagtattttggacagcaaaagaccgttgaaatgttaaaaatctccggtgaatatttttaggtaaatttagggtctgttcctacagatactaaatattttagtctttgcatgtcatatagtctctgtctcatctactaactctgactttgcagttaatacccagcaatgggcaatatatcaataaatgggcatggctccgtttcaataaaactttattataaagacatggttggctgaatttggcttataggctatagtttaacaatccatggtataagacagaccagtttgtgataaaacaaaatggacaaaattgtgtctgtgtctgtgtgtgtgtgtgtgtgtgtgtctgtatgcaaaatcaatggaactgagaggattccaattcactttaaatattttcaaatacaataatgttgaagttacaataaagttatgttatgtttgatccaatacttgcatgagggtatgacttagtgcgtttaaacagcaacatcagtattattttccagctccccaagtgtctgctcaggctgccacaacaaaataccatagagtgtatggcttaacagaaacttatttctcacagctctggaggctggaagtatgagaccagggtaatcacatggtttctggtgacagctgtctgatttgcagatgaccaacttcttactgtgtgctcaaatggcatggcagagagggagggagagaaagagcatgctctctggtgtcttttcttgtaaggactatcagacaaaggctccttcctcatgacctcacctcatctaaacttaattatatcttgaaggcccctgtagtgtgaagggtcccaatcagcttactaaaaggtttatttctgctgcccaaaccctgaaggccaggccatgagccaaggccatgttgcccagccagagagcaggtgtccctgagaactcaaacattccagacagtatctgagaacctaccaagaaaaagtctcatcgcttaaacacagtaagcaaggagccagaaaattagctgaaaagtactttaaaaataataagcggtgcagatctctacagctgtcctgctgttgtcccggagtgcctcctatgtgaatcctaataatctcatctactcgccaagctggacttctccaagtcatttcttgatctcttggctcactcccagtttgggagaaggtatttctatatgattccaggattttctccttacagccccatcttcaaatactatcaccttggaagatagtgcttcaacatgtgatttggagggtacatgaacattcagttgatagcattctgcccctggggcccccaaattcatgcccttcatgcatgcaaaatccatgctttccaaactcccaaaacaacccttatttctttgaggacaaaaactgcctttgtagaactaacaaattagccacaagattagaaattatggctcaagagtcatgtagccagaggtcacaaggctcataacctccccaactgcttctatagatagcatcactattgtaaaacctaagactggtgttcaaaacccttcattctgttgtaccagctggttccacctggactggtaagctggtttaactggtcttgtgatctgacccaggaactgacttagcacaagaggacagcctcaaccccctatgacttaattcttgacccaattaatgaggatgaccccttctctagcccccacccaccaaattatcatttaaaaaccctagtctccaaatgtgggggggagatttacttgagtaataaatccctgacttctgtatggctgaccctgcactaataaaactattcctttcctgcaatactgctgtttcactaaattggctctatctgtgcagtgggcaagaagaaccagttgggcgattacactagtacagccactccctcggtgttctcttcaaacatagattcttattttttgcagtattgataggaaaagaaatacccaccacattgggagttggggctttcacataaatttttggtggacacagacattcagaacataacatcaggtgatgtaaattacagccatgtttaaaaaccaagctgctaaagagtgcttcttaaaattaagagtgtgtattgatcacctcgagtcctgttacaatgcagattctcatactgtaggtctgagttgtggcttgagattttgaattgctaataggttgtcagttgagattgatgctgttggtacatagaccacactttgagcagcaagatgctctggttttcaatgcctgtgatgcccgggtcctgccccaaagacttatttatttcatctgggatgtggcctgggcattgagattttcaaaagttctgctgcattctaatatgcagcaaggcttgagaacctctgtgccaaaactcatgatgatgtactgattctagttatgttatcagtagccttaatgtgttcccttttgctcattcttgccccaagccccacccagccattcctctgcttttcaggtccaaacatccagatgaaggtggggatcaaggtgagcacttcatcctgttgctcttatccatctctgaggagtgggaggcagttctggatggaaacaggaggctcaagcaacctgagattgattgggaagaacaagcacaatattctaggggcaaattcaagggtaagctggttgagatagaatgaggagggggaatacaatgaaaaagttatcacagcaaagcctgtctccagtcttggccctgagagtgggacagtaaaaacagccatgtacccccctgagtcctgatagcacctgacaaccaaaccatcttctaagggtttttccttctcagtatgcaaggcgacgtggttagtagaaatgcaagagtgacccccagtggcaaagtatagaagtgaagtattttccccaaagcataaacgaagcaagggaacttaagagtagagcataataatggtgagagtgataaatcatggctaccacatagtgaacatacactgtgccaggcactactgtaagtgatttacatatattagcttatttaatctcaacaagccaatgatgttaatgcttttattatccccatattacatagggagaaactgaggcacgccacggttaaataacttgcccaagtttacccaagatgagtggataagctggaatttaaaccaaggcaatctgaggttaacaaaacattacaccaaattttctctccaaaaattaaaaagacccctcagtcaatgtaaagtttgaaacattaaaaaatagatacttgctctgttctttctcatatttacaggagaacagtcaatggacatatatatttcaataggtaatacctgagacaaagtcagacagtgcagcagtccttacagcaggcagagaaaaagatacagtgagaaaaccaagtttgactaagacacataaagaggcaatagcattttctggaaactgaactcaaagtgccagaatcctaatttttaagaaaggtgttaaagtgcagtcatggggaaatgtggaaaataattactacatggctaaacttgtttgtatttaataaattttcaatgcaatctgctagctttaacaagatacaagttacccatgtgtctttgactaaagcatatagtctgtaaatttttgacttttatctttgtaacccacaaaagaaacaatattgtcttttgtagcacagaagaagcaagatgttttgagtatttttctacagacatggacaaccttagggtttacatggatggagatttcctttggtcaaatagtgagtggactgagaggggagaagaatttttaaagggaaacaggaaaaaaacagagaaacaagtgtattatttctgtgtggaatcttattttcactaggaaattatttctttctacctatagccatgaagaaaatataaggctaactattctctatgtctctaaagaagaaaccagaggctacattaagcttgtcagaacaggctgattttgaggtaaaattggagcagacattaggggtcatagcctagaataaggtgatggtcaaggtgggaccagcaactctctgggtgttcaaacacctcaaccatcccctaaatgttagctgccctgcactcggggctggatttgtcatactcttcctcacactctctttctggtgagctcatccaatcacatgacttcaataccatctataaaatgtctcctgtatgtgtatttccattcctcacctcctgtccatgagcatcgcttgtcactttgtccaaaatccatctaaaacttgtctacctctcttcatttaatcagccaccatcgcagttcaagccacactagtctcttacttgggcaatatctccacctggtctctactttcaactctcccacacccctctatattcttcaaaacagccagagtcactggcttaacagtcaggagtacatatactactttatattcaatatcacaaatttgaccttcaaccttgatcttttatttttcattccttctactgaagtattttttaccatgttattttattggaagaaatggcagaattgaaagaaaaaatcaggagtggaggatttgtaagggtaatatgcaggaaatcacctcatatctgtggggaatccagcctaaggctcagtcccattatcactgtaactcagggtgagcttgccaaagtacactgccatactgtcacccagagcctccatcttgctacctaaaatcagtaaatgttaacatttgcatacttccataaactacaagtttttatgtagggttgaaatccagctttattttaatccctgcccaatcccattcccttcacttcttccccagaggcaaccactaggatgaattccagaccatgttttaccctttactgtgcacatgcacccacagacaccatggcccaagaatacccaccccaccccaccccatatatccgcatagtttataaagggacgattaatgtgttttccagggacctacagaataccattcccctccaccccagtagatcctgaagtacatccacgtagggcaggggtgggtggagagactgctggataaaacaaacataagaagactctgtagtttctttctgtcttctgagatgccccactcatctctccttctgcatctttgcagtcttattttatcaccactttgcctcatccatgaaatatcactctggtttataacctaccttgaaagggagacatggtcaccaccttcaggatctgcaagaactatgagtccatttccaggatgacagtgtgaggagctacaggcacctactgcccagtgaaataggcgaagctggtgaaaactattaaaaaaaaacataaagtttctagaaatgtttccatggatatagcaaatgaagaaacatttatttaaaaaattattaaagcttgaaaagaacagtgagaatttgtggcatttgagccatgacctgcttcctatctccccaaggagttcaacttgacagaagctccactctgggtaagtgtgacctaaaagacaaagctccgtcttctctcaactctcaattaatgcttaccacatttcaatgggaggggcatgccaccagtatttgtgttcttccacttcaagttgtataggtaagtccctggtgactgtggatgaaaggtcatcacttccttctttaaaccagaccctaccccattggatgggggctgtacccaaggcatgaaagaacaagaatactggacttgaaactgcccttaccacagctcctccttaggaaagaggctccatgcttggagagacaatctgagaagatcagtggcttccatgccatgcaatgtccacagagtcttccccgggagggaggctgtctataggaaaagtatactaaattctctctatagaaactgagtttttttaaatttttaattgttgtgggtacaaagtgggtgtatatattatgggttacatgagatatttttgatataggcatacaatgcgtaataatcacatcatggaaaatgaggtgtccattccttcaagcatctatcctttgtgctacaaactcttttagtttgttttagctacactctttgagttattttaaaatgtgcaatgaaattattactgaccatagtcaccctgttgtgttatcaaatactagctcttattcatttgttccaactattttgagtactcattaaccatatgcacctcccctttctcctcccttcccaacctctagtaacaatccttctactctctatctccatgagttcaattgttttgattttcagatcccacaaatgagtgagaacatgtgaagtttctctttctgtgcctggcttatttcacttaacataacgaccaccagttccatccatgttgttaaatatgacagcatctcatttttatttatggctgaatagtactccattgtatacaagtaccacattatccattcatatgttggtggacagacatttagattgcttccaaatcttagctgttttgaacattgctgcaacaaacatggaagtgcagatttctcttcaatattctgatatgttttgttttggatatatacccagcactgggatcactgtatcatatagtagctgtatttatactttttttgagaaacctccaaactgatctccacagtggttctactaatttacattccgccaacagtataggagggatcccttttcttcgcacccttgccagcattcgttattccctgtcttttagatataggccattttaactgaggtgagatgatatctcatagtagttttgatttgcattttcctgaagatccatgatgttgagcaccttttcatatgcctgtttgccatatgtatgtcttctattgagaaatgtctattcaaaacttttgcccaatttttgattggattattagatgttttcctatataattgtttgagcttcttatatattcttgttattaatcccttgtcagatgagtagtttgcaaatatttttcccattctgtaggttgtttcttcactttgttgattgtttcctttgctgtgcagaagctttttagcttgatgtaatctcatttgtccattttagctttgatatcctgtgcttgtggggtattactcaagtaaattttgtccagaccaatgtcctggagagttttcccaatgttttcttgtaataacttcatagttggaggtcttagatttaagtatttaattcattttgatttgattttcgtatatggcaagagataggggtctaggttcattcttctgcatgtgaatacccagttgtcccagcaccatttattgaagagatggtcttttctttagtgtatgtccttggcacctttgttgaaaatcagttcactggccaggcatggtgtctcatgcgtgtaatcccagcactttgggaggccaaggcgggtggatcacctgaggtcagaagttcgggaccagcctgaccaacatggtgaaacccatctctactaaaaatacaaaattagctgagtgtggtggcccatgcctgtaatcccagctacttgggaggccgaggcaagagagtcgcttgaacccaggaggcagagtttgcagtgagctgagattgcaccattgcactgcagcctaggcaacaagagcaaaactctgtctaaaaaaaaaaagaaaagaaaaagaaaaaaaaagaacaaaaagaaaagaaaatcggttcactgtaggtgtggggatttgttcctggtatctcctttctgttccattggtctatgtgtctagttttatgccagtaccatgttgttttgatttcgatggatttgtagtgcaatttaaagttgaataatgtgatttctcctgttttgttctttttattcaggatacctttggctattctgggtcttttgtggttccatatacattttaagattgttttttctatttctgttgaaagcatcattggtattttaataaggatagcattgaatctgtaggttgctttgagtagtgtgaacattttagcaatattgattcttccaatccatgaacatggaatatattttcattttttgtgtcctcttcaacttctttcatcagtgttttatagttttgtagatatctttcacttctttggttaattccttgatagtttatttaatttgtagctattctaaatgtgattactttcttgatttatttttcagattgtttgctgttggcatgtggaaatgctactaattcataaggtgattttgtatcctgcaactttactgaatgggtttatacgttctaataattttttggtgaaatctttagatttttccaaatataagatcatatcatctgcaaacaaggataatttgacttcttcctttccaattttgatgccctttatttctttcttttttctgattgctttaactaagatgtccagtactatgttgaataacagtggtgacagtgagcatccttgttgtgttccagatataaaagggaaggctttcagttcttccccactccatttgatatcagctgttggtctgttatatttggcttttattatgttgaggtattctcttctacacctagtttttaagggcttttatcacgaagggatgttgaaatttatcgaatgctttttcggcaacaattgaaatgatgatatggttttgtccttcattctgttcatattatgtgtcacattgattgatttgtgtatgttgagttatccttgcatccatgggatagatcttacttgttcatgatgaatgttctttttaatgtgttcttgaattcagtttgctagtattttcttaaggatttttgagtgaatattcattacagatattctcatgtagttttcttttttgatgagtgttagtctggttttggaatcagagtaattctggcctcatcgaatgagtttggaagtattccctcctcctctatttttcagaatagtttcagtaggattggtattcttctttaaatgtttgatagaatgcaacagcgaagccattgagtctcgggcttctctttactggaagactatttatgatggctttgattttactacttgttattttttttcacattttggatttcttcatggttcaaacttgataggttgtatgtgtctaggagtttatccagttcctctagattttcccattatttggcatatacttgctcatagtacccactaataatcctttgaatttctgtagtattagttgcaatgtctcctttcccatctctgatttgatttatttgggtcttctccctttcttcatctagagaagatgcttgatattatctcaattttttgaatgttttaagacttattttgtgatcatatctcaagtatatgatctatccttgagaatgatccctgtgctgaggaaaagaatgtgtattctgtagcccttggatgaaatgttctataaatatctgttagattcattttgtcaattgtgcagactaagtctgatatttctttgttgactttgtatctagaagatctgtccaatgctgaaagtggggtattgaagtctccagctattattgtattgggacttttctccctttagtgctaataatatttgttttatatatctgggtgctcggatgttgggtgcatatatatttaaaattgatatagcctcttgctgaactgacccctttatcattatagtaaccttgtttacctcttcttatagtttttgccttgaaatatattttgtttaacacaagcataataactccttctcttcattggtttccattgacatggaatatatgtttccattactttattttcagtctatgtgtatagactaagaagtatactggaagtgtgtttcttacaggtaacagatcattaggtattgtttttttcatccattcagctactctatgactatttattggagagtttagtccattttcattcattgctattattgctaagtagagactttttcctgccattttgtatttattttctggttgttttgtggtcttctcttccttcattccttccttctttcctttctgtcttcctttcagtgaaggtgattttctgtgactctgtgatttaatttcttaatttttttgtatccattgtatgttttttgatttgaggttattatctcataacccattattttaaactgatgacaacttaacactgattgcatgagcaaataaacacacaaaaggaaatctaatagaagttctatacttttcattcattcccctgcttcttaactttttgctctttctctttatgtcttattatactgtccatgttttggaaagttgttgtagttattatttttgattcattcatcatttagtctttctacttaagataacggtagtttacacatcacaattaccgcgttataacattctgtgttttttgtgtacttattattaccagtgattttgtatattcagattattttatattgttcattaacatccttttctgattgaagaactcctctagcatttcttttaggacaggtctggtgttgatgaaatcactcagcttttgccttggaaggtctttatttctccttatgcagaaaagatattttcaccagatatgctattctagagtaaaagtgtttatccttcagcccttaaaatatgtcatgctactatctcaaggcttgtaaggcttccatcaaaaagtctgctgccagatatattggagcacaattgtgtattatttgtttactttctcttgctgcttttatgatacttttaaatctgtaacctttgggactttgattattaaacaacttgaggtagtctcttctggattaattctgcttggtgttatatagccttcttatacttgaatgttgatattctctaggtttgagacattctctgatattgtccctttgaatcaactttttacccccctctctctctacccctccttttaggccaataacttttagatttgctcttttgaaactattttctagatcttgtaggcatgttatattgttttttattcttatttattttgcttcctttgactgtatattttcaaatagcctgtctttaagctcaatgcttcattcttttgcttgactagttctgcttttaagagactgatacattcttttgtatgccaattacctttttcagctctagaatttctgcttgattttttaaaaaattatagcaatctatttgttaaatttatctgataggattttgaattctttctctgtgttatcttggttttctttgacttctctcaaaatagctattttgaattctctgtctgaaaggtcacacatttctgtctctccagaattggtccctgctgccttatttagttcattttgtgagctcatgatttcctggatgatcttgatgcttgtagatgtttgctggtgtctgggcagtgaagacttaggtatttattgtcatctccactgtctgggcttgtttgtgcccatactacttgagaaggctttccaggtattcaaagggacttgggccccaagcccaataatgctgtcattttttccaacttgtagagggattgtcttggtggtcttggataagatcaggaagaattctctggattgccaggcagagactcttcttctttcccttattttctcccagacaaagtctctctctttctctatgctgttttgcctggaacttggggtgtggtgatgcaagcaccactgtggccaccaccactggaactgcacttggtcatacctgtagccagcacagcactgggtctcacacaaggcctactgtaatcactacttggctattaccatgttcactcaaggccctagggctctacaatcagcagatggtgaagccagacagatttatgtccttttcttcaggacaatgaattctgcaaggacccagacagatccagagttgcagtctgggagccagggattagaatcaaaaaccttagaaatttacctgattgggaggctgaggcaggcagattacgaggtcaggagatcgagaccatcctggctaacacggagaaaccccatctctactaaaaatacaaaaaattagccgggcgtggtggcaggcgcctgtagtcccagctactccggaggctgaggcaggagaatggcgtgaacttgggaggcagagcttgcagtgagccgagatcgtgccactgcactccagcctgggtgacagagcaagactccgtctcaaaaacaaaacaaaacaaaacaaaaaaaaaaacagaaatttacctgatgttctattttactgcagctaagatgacattcaaaccacaacacaatgtccttcccaaactttcttcccctttccacaggcacaagagccttttcctgtggctgggggattctgttaggcctttgctgatgttcacttaaatctcaaaggctcttcagtcagcttatggtgaatattgccaggcctaggactcacacttgagggcagtgggctcccctcttgcccagggcaggtccagaaatgctgtccaagagcctagacctggactcaggaaccctagtagcctattcattgctctccccactgtggttgagctcgtacctaaggcacaagacaaggtcccctttactttcccctctgcttttctcaacaggagtatttcagcatagccaccacactggcaatatgctgggtcttgcctgaagtcagcacttcccaaggcacatggaatactagcagggtattgctgctggttattcagtgcccaacggctcgtcagttaatgggtaataaatcttgccaagactgggttcttcccttcaaggaagcaggttccctttcagcccagagtgcatcaagaaatgttgtctgtgatctaggtcctggaataggggcctcacaactccgcccattggcctaccttactgtggctgagctggtatccaagatgcaagacaaagtcctcttcacacttctctctcctctccataagcagcaggaagggttcactttcattgctgcaagctgtactgcctggggtttgtggagaggcggtgcaagcactcccttactcaccctagcttgtgtcttgctacatcatatgtcactctattccactggccttgaggccagcccagcactaggagttgcctaggaaatgcagtccttgtatcctaggctgtctttcaagtttacctaggaccccaaagcactgtggcttcagtggcaaggcttgctgagaaattcacattccgactgctgggatgggtgattcccctctggctaggactggtcaaagtgctcccaccatgtgtaggcactggctgggccaagccccaactttgctctccattgtgacagggaagcactgagttcaatgtaaagttctccagttgctgtactctccctgtcctaaatgcacagattctctgtatcacatgactgctatcggaggatggggagggagtggtgttggtgatttaagactgtctgtcctacccacttcaatgcctcttttagcaatatgaagttaaaaccacatactgtgattgctcacctgattttttgttcttgtgactgtacttttctgtgtgcagattgttgtttaaatttgctgttccttcaggatggatgaatagtgtaggcttctattccaccaccttgctctgccccgacttcagaactgagttatttttttttaagcagagtgtgagagcattcaagccaaagactggtctgaaaaacaatagcttctctttttttgaaatttattctattgtaaagcaaaaccaatgtatgacttaatataatttttatgaagtgccatccttttaagcactacacaggagaaaacaacagcaacaacagaacctcacccatcacccagcagcccctccatgtgtccacttcaatcacaccagcctcactcgctaaagtgacctccaacctgatttcataacaatcacatctgcattcttttacagctttattactcaaagagcatccctggatactatgatttaaactcatccttcatgctttttattttttaatttttaatttttaaaaatattatatatagttaagatataccacatgatattttaatattcatatagataattaagtggtaactattgtcaagcaaattggcatatctattatctcacataattacctattttatttttctggcaagagcacctaaaatctactcttttagtaaaaatcccaaatacaatacaatacaatagtatttagtataggcctcaaggtatccattagatctctagaattgttcatcctacatatatgtttctttgtagcccttgacatacatctcctcacttcttacctccatccttgccccctggtaaccactgctttattctctatctctgcgtattcagctttgtttgcttgtttgtttttagattccacatataagagagatcatgtagtatttttctttctgtctggcttatttcatttagcataatatcttccagattcattcatgttgtgaatgttttgatatatgcaaatcaataaatgtgattaaccacattaacaaaatgaaagatacaaatcatatgatcatctcagtaaatgcacaaaaagcatttgacaacattcaacactctttcatgataaaactctcaacagaatagatatagaggtaatgcacctcagcacaataaaagtcatatatgacaaactcttagctaacatcactgttggactgcagtggcatgatcatggctcactgcaactttgacttcctgggctcagatgattcttccaccacaacctcccgagtagctgggactacacttgccaccaccatgcccagttaacgttttgtattctttgtttagagggggtggtgaaaatttgaaagctttccctctaatatcagagaaaagacaaggatgccccctttcactgctttttttcaacatagttctagaaatactagccagagaatttagacaagagaaaggaataaaagggatccaaataggaaaggaagaagtgaaatttttttctgctgacacataatctaaatatagaaaatcctatggaatccatacacacaaaaaaaaactgttagaactgataaacaaattcagtaagttataaaatgcaaaatctacatacaaaagtcatagcatttctaaatacaaataatgcactgtctaaaagggaaattaagaaaacaataccatttacaacagcaacaacaacaacaaatattcaggtgtaaattttattaaggaggtgaaaaacttctatactgaaaactacagaacgttgttgaaataaattgaagaaaatacaaagaaatagaatgatatcccatgttcatggattggaagaatattgttaagatgtccatgttggctaggagtggtggctcacacctgtaatcctggtactttgggaggccaaggtgggcagtttgcttgagcccaggagttcgagaccagcctgggcaacatggcaaaaccccatctctacaaaaaatacaaaactttaactgggcatggtggtgtgcaagtgtagtcccagctacttgggaggttgtggtggaagaatcatctgagcccaggaagtcaaagttgcagtgagccatgatcatgccactgcactccagcctgggtgacaaagtgaggacctgtctcaaaaaacaacaacaacaataaaataaaacatgcccactgcaacctctaacataaggaaaaggatatatttctcagaaaaaatatcctaaaatttgtatgaaaacacaaaagacatcaagtagcaaaaccaattgagcaaaaagaaagagaatgaagctggagatattgcaatacctgatttcaaaacataaagcaattgtaatcaaaacagtacagtagtatggtactggcatacaaacagactcattggtcaatggaataggatagaaagcccagaaatctatgcatttacagttcattaattttttacaaagttaccaaaaacatacaatggggaaaggacagtctattcaataaatggtactgagaaaaccggttatctatgtgcagaagaatgaaattagacccttttctcacatcatgcacataccatgcacaaaattcaactcaaaatggattaaagatttaatcggaagacctgaaactataaaatcacttaaagaaaacataggagaaaagttctgtgacactggtctgggcaaggactttttagacacgaccctgaaagctcaagcaacaataaactaaaaggattgcaagaaattaaagcttctccacaacaaaagaaataattaacaaaatgaagacatagccaaaagattgagaaaaaaaatatttgcatgccatacatttgataaggggttaatatccaaaatatataaggaactaaaacacctgaatcatagaaaaccaataacccatttaaaaaatggacaaagaacctgaacaggcacttctcaaaagaagacatacaaatggccaacaggttcatttaaaaaatgttcagcatcattgatcattagggaaatgcaaattaaaactaaagtgagatatcaattcacacctattagaatggtttttatcaaaaagatgaaagacaagttttggcaaggatgtttagggagcaattgtgcactgttgctaagaatgtaaattagtacagccattatgaaaaacagtatagagattcattaaaaaaaatcttaaaatagaacaacaatcccacttctggaaatgtatccaaagtaattgaaatcaatatgtgaaagggatatttgcactctcatgtttattgcaacattattcataatagctaagatacacaatcaacctaagtgtctatcaacagatgaatggataaagaaaatgtgatatatataccaaatacaatactattcagccttagaaaaagaacaaaattctgtcatttggggcaacatggatgaatttagaggacactatgctaagtggaataagccagacacagaaagacagatactgcatgatctcacttttatgtggaatcttaaaaatgtcgaatttataaaagtatagagtagaatgatgcttaccagaggctagggagtgggagagtgtgaggaagtggggagttgctgcttaaagtgtacattgtttcagctagacaggagtaatacattttgagatacattgcacagcagggtgactatattcaataataacatactgtatatttcaaaataactaagagtaaatttcaaatgtatcaccaaaaaacgtcaaacaaattaggtggtagatatgttatctagtttatttttgttactccacactgtatacatatatcaaaacatcacgttgtacttaataaaggtagtacaattacgatttttccatttaaaatagtattaataaaaaagaaacaagagtatgttgctcagaagagtaaaggatcagtagcatttcctagaaactgagtggaaagaaccacaatccttatttttaagaaagtgttgaagtacagttatgaggaaatttggaaattaattattgcttagctaaacttgtttatattgtatgaaatacctcaaagccatctgttagctttaaaaataactactcatgtgtctttgaatatatgatacaaatctatacatttttaacttttttctttgtaatgcacacaaggcccaaaagaaacaaaatgtatgtttttcccagacacagacagccctagggtttatatgggtgcagattcatttggttacataaagaaggaactgagagagaggtacagtgttgaaaagggaacagaagaaaaaggaaatacatacaaatacatgtctatcacttctttagaaactctttttagtagaaattttttttttcctacacacaaccatgaagatgaagtaaaaggctaacacttctttacatcttgaaagaaggactaaaggccacattgaggtgaggaattggctaattttgaaataaacttgtggcagacactggagccacagtctggaataaggtattggtaaaagtggaacctgcaattctctgggtgtgcgaacacctcaaccaacctcagaatgttagcttacatgggcatggggctggctatgccatactctgttacactttttttctgatgagcttatccagtcacatgatttcaataccatttatagaatgatctcccaatgtgttcgtttccaaaaccggcattcatttttcctgctaactgcatgacattttgacttaaatgtctaataggaatctctgattatacattatatgccttccccaaccctccaccccaagtgtcccccctgcaagctccccagattttaaaatatcacctttaacccaggcgctcaaggccaaaccccggaacataggttattttccccatctcacgttcctcatttcccatccctgggcaattcttgttgacttgtccaaaatccacctggaacttgtctacctcccttcatttcctcagccaccatcacatttcaagacatgctagcctctcatctgcaccaactacaatgtctctgcctggtctccaccttcaaccctccccgacacccctacattcttcaaagtagccagagttctactttatattcaatactataaacttgactcccaactttgaccttatatttttcagctcttctattgaggtaatttgtttttctttggtaccacgtcactttaatggaagaaatgattcaatcaaagagaaaaaaaaaacaaaaataaataagtagaggttttgtaagggcaatatgtatgcccagccctggcgaccacagaaatgcatctcctggcaatggggaagccagcttaagtctcggtttccattatcactattactcagggtaagcttgccaaagagacgctctgccatgtcatcttccaaataccccatcttgctacccagaatcaagaaatgttagcatttgcatatttaaaaaagaaaacttttcatgtaaaattaaaaacctcattattttaatccctgcccaatcccattcccctgactttttccccagagacaaccactaggatgaattctagaccatattttacactttaccatgcacatgcacccacagacacaagggcctaagaccactcagcccaccctccctaccccatatatccacatagcttagaaagaaaagattaatgtgttttacagggactcatagaataccctccacctccatccttagagaccccgagctgcatgcagatggagcagccctgggtggaaagactgctggacaccctttttaaacttgcatggggatttgccctagttagtaaaaggtgagagttttgcaggcacgcctcaactggacaccttcatcgctttgagaaccagataactttattgccaacaatggtaaaactgaaaggaaaaaactgaagagaaggttctgaaagggtaacatgcacgccccgccaggtggcccgacccagggaaggcacctcgtggctgtggggcccgtctgggctcaggtctcttcgtcgctgtggctcagggagagtttgttaaacaggttctcagccaggccggcttctgggacccacatcttccccaggttgttcacatagccacccagctcttcgatggtcttgacctgttggtgtaggtagtggctctccaggaagtcgcacagctgggctcgcccttctccaaggccagctggtgcagctccaggaggctgtagttgatgctcttctccaggtggaaggcacactccatggcctcgagcccgctctgccagccttggcgctctggctccctgatgtcatgaaggcagatgcggccactgcgctggttctgcagcctcatcagctcctgggcatgctccatcttctcgtctgattggtgcaggaagtagcggccaaagtgctccagggccacgtcatcccgttcaaagtagaaagccatggacaggtacacataggaggcgtggaactccaggtcgatgtggctgttgatggcggcctcgcagttggtgtggtagctgtggcgcacctgctacagccgggcggtggccatggcgggcaacgctgacaatgagcacgcaggcaaaggcagtagcgcgcaggcagcggtagcggtggcgaggaatggcggacggtgaatggcggttgtgtgacggaaccggaagtgggcagtggagactgttatgaaggaaggggcgtgcttcgaggctagttggtttgaatgagggacagacttcgggggcgaggtgtggggctccagcgttccatgagttccataagttccacctgaaactccagagttccgtgagttccacctgaaactccagagttccatgaactccacaaactccagagttccgtgaattccacctgaaaccctggcgactggactgtaacctgaccttttcacctataacgtatttttaaagttatttatgaatataagtgtaaccactttgagtgaatcacctgggtgatttcttaaagaaatttattacaatattatcaaaatgtgattgttttatcaaatgtactgttttttgtgatgtcattagttatacttaatatcacaaagctttatttgaatggcagatatcctcagtgacttcagcatccttactagtgacacttccaataacctccttactcacttcctagaccttattaactttagcaaccttcattttttttctttctactcatggtcaagttccctcttctctgacagcagagaaccacctccaaaatatcaaacagtgaacctttccacctttccatgtttcccactctttgaacttgttcttcactcctttttctcttctagtatcttaatctttcagcagcatcctagaaacacttttttttcaagtcgtcctgtctggatcccaaaatagacaattccaagatctcttccctgacatcctagatttgctcacccctttcacctagattgcaaatttcctcttcttgggtaagtacagacttaaaagccttgggtgaattcttagagaaagcacaacaccttcaacttcctttacttccattgccactcagtaagcctttttaaatttaatccttcttttaggttctatgaaatgagtcatattagcattgtgaatttaggcagttcttgatctatattttcagcgtactgctacttcattaaaagtatgtagatacagaacaaatgcaataagcatatgttattcctttcttaggaagtaagagagacattggattctgtgtcaaatagacctcatttggaagcttgacttcacctatttcgagttgtgtgaacttgcattagtgttttactcctgggaagaataataccaataatgagttttaagtaataaattagatgatgcattaaacatgagggttatatagcacttagtttaatgattgcaatcaatgtgtgatagctattattttttaaaaataggctgtccctgagaaagctgtctaatcattatataaatgctcaccttagtttaactttagatttttatgttataattccaaaaggcaaatataatacctttttttctttcctcttactctgtccttttttattttcagctaatcactaaaatctcctttatgttatttctggtggaaatgttagaaaatgctatcctaaaatatgaatagcttttgcaatcaataaatcccaaagattagtctgacaaagtgacaaacttcaaaaagtagcttataaaaaggataaacttctatagacatttcttatattattgtcctgaattgttatttaattttgagtatgtctgtcttgtttctctgccaaaattgtaaatttcttaaggtcaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcacatggccagagtgaagtcttaacaatagggaagatcatagaggtaagaaaagaaatattgaatagagtctggaatgcaggagcatgtatgtgtggctgtgtggcggtgtgtgtgtgtatgcttgtgtgtgtgtgtgtgcgcgcgtgtaggtaagtttggtaagtttagatgagcctggaagattagcaggagtgtgaatttcaccagatcttcatgttacaaaaatatgctcaaggagaaggctattttggaaaccattgcagaaatacaataagatatagtggtgacacgaacttcaagttatggtggtgggttttgagggaaattctgggacttggcttacaaaattacctagaaaagacctagttcctcaggcatatgatgcttacaggcaagctgcactacaaacaaaatattttcacataaacagatacacattccctcttgctaggatgaaatatataaatatacttccatttacagatggattccttcattattggaaacagaaatacacttcaaatctgtgttacaaacttctgaagcaaacaatttattttcctcagacagttttacccgttattttgaaaatataaagaaattgcttgatatcttcaatttatgagtgaattttacatttctactcatgaaatgcaaagattaactgcacttgaatagatatatgaagatattgaggttgctgtgcagctttgctcatacaggcctattttgcacactaggtttgtcaaggacttgaagttccctgctattctgtatctgtgttatatgatatgaaaatagtcatttgtggtaaatttttatgaatatggtaaaaatctttatatatactcaatctggaagtataaaactgcaaaaccaaagtttaacctataattttgttaagcagttttcagtctgtttttatttttatttttatttattattattattttgctttatttttgagacagagtcttgttctgtcacccaggctggagtgtagtggctctatcttggctcactgcaacctccgcttcctggattcaagcaattctcatgcctcagcctcctgagtagctggaattataggcacaagccaccacacctgactagttttttttgtatttttagtggagatgaggtttcaccatgttggccaggctggtctcaaactcctgacctcaagtgatccacccacctcggcctcccaaagtgctgggattacaggcatgagccactgtgcccagcctcagtgtggttttagaacctgatgcaaacctataaggggaaataacaatttccttattaaatgggccaacattgaggagttgatgtcagcaacatggtatactaggaggtccgaatgttgacctccccagaaaaataatgattaaacaactacttactgacaaaaacagctctgggagagttccagaatacaatgaaaaagctgcagcaaccaaattggagcacgaaatcttaagatgacagcataaaaatgtatcggaagcattttccgacatcaccacctccgccagtctggcacaggttgatgccaagaaggattccattggccatgacttttccccatgggagaaaaggagaggatctctcgctactgaggaccctttcagtcatcactgctcagagaaggacccatttttgcctatcaactctgcactagcattcaacatacatccccaggtactttcgcctctgctcctcgcatgcccatgccccagactccagcatcaccaatgttccactgaggcctgtaccccagaaactagcaccacttgctgccacagttgtgcctgcatcccagaccttggcaccaccactgttctatgcatgcccataccttgggccccactgccacagccactctttatctgcctacttcccagacaccagcattaccactgtgtacactcacaccctggaccccagctctaagatggacaccctcagtggtgactccccctatggtggaaaataagacaccagaagccttcactgctactgcagacacatacagccttggccaccaaagattcctgtactcttcactgatgtcctcagctgatggaccttcctagggtttatgctgctgcaccaagaccaggggacagaaccactgcacctcacctggctagcagcctcacacccacccatagatgaaggtctttcccccactgaagtcaaaaaagaatatctctaaaaggtttcatcagtatgaacacttaaaacatgcagaaatattgttggaagtgggaacgtgaaaggtactgctatgttgctagaagaagttctcgatcaatggatgacagttaatactttggatttcttcatgcagatcagaactctacactgaagcaagctgttcagtcatgtcttcaggtctaatatctgaatattatggagcaggtggtactaatattaataatccagtcaaagtttttgttccaaaatacaatgactatttgatggcctagctttaggattatattgatcatgaaactttttttcttctaatattggtgtcctattttccaagaattttatgtctgtggccaagactattaagtgtctgttcaaattttacgcccatatttcttactagcactttgggtctgtggtgcaaccacaagaaaactcccatggcaacaccttcttcaagtgaaggacagttctcagggtggctttggaccagtcgagttctttctcctttctcgtttgtagttctgaaaaataactgtagacggtgccaagaatgcaacatcttcagatagggctctgttccagtggccctagaaacaggatgtccttcaatacttcagcccagtgattattctatctctggggtataaaacccagggcaactttctggggtccctccgctgtggtgaaagtggagtacatgcagacaaaactccatctaccacaggcagcattcccgagccttagggggctggcttacagtgaatcctaggctttgtggtcccttgctgcctatctgtaaggaataaaccctcttctgtaactcattgtgtgcatggacattcagtttcactgaactcagacaagttggtaaccagtgcacagtgaatctgcttcatggtaagtaccttattttatttgttcaagagttcaatttgactgataggcaagaattggcaccacttcaagaattcattgagaaactttaattgaaagacaaataaatgtttcttctgcaacagttactctcttgcttcatctacagctagagttatctcaatgctaatctgttatcaactagtgttgtcagttgagttgtgtctccctaaaatttgtatactgaattcctgtatccccagaacctcagaatgtggtcttatttggaaatagggtcattgcagatgtaatcaagttaagatgaggtcactagggtagaccctaattcagcctggtatccttacaaaaacgagacatttggacataaagacatacacctggggagaagtccacgttaaacatgaaggcagagattgaggtgatgcatcttcaagtcaaagggagaagcctaaaacagatccttccctcatagcactctaaaggaaccaaacctagcaaaactttgattttggacttctagcctctaaaactgtgagataataaatttatgttgttctaaaccacccagattgtgttactttgttgtagtaacccttagtaaacaaatacaattaatgatacaaagttagagaaaacagtatacaaagaaacccattgtctgtgcctgctgataaaaatgtttccattggtagtttggcttcggagcaagaatttaaaaacgtaactaattttgacatactctatgacctgttattgtcatgaagttatacttggttgtaatatatgatgactacatgtagtttattagtttagatattgttcctttgctgaataaattgattgcatctgtttcaggtgacagcataatggataatgagaatttccaccaaatgattagaaggtttccaaatcaaactttctgacaacacgatcacataatcagataggttttattcttttttttttttttgagatggagtctcgctctgttgcccaggctggagtgcagtggcgcaagctctgctcactgcaagctccgcctcttgggttcacaccattcccctgcctcagcctcccgagttgctgggactacaggcgcccaccaccatgcccggctaattttttttctatttttagtagagacggggtttcaccgtgttagctaggatggtcttgatctcctgacctcgtgatccacccacctcagcctcccaaagtcagataggttttcttctacttcaattttacaaataaaaaaggcatttttagatttccttaatattaagaatatttgcatcattttatattttattttcaagtttgtatgccagcgattttatggataagatggatggatagatcgtttttgttttgtttggatttgacaaaatccatgattgttattttaatcatcataagacatgatatgggaacaaccaaagtttttttttctaaaattcccttttatgttttagtcttcatttggaattttatcaacacacaaaggttgttagaaggttatacgtgtacaaattagaaataatttctttttaagtattctaaggattatcttatagatttttattttacaatgctttattcaaattaattttaacacatgaagattttggttaagaaaaaaaagatcttccaaaagtaatcgcaaactgtattaggtcattcttgcattgctataaataaatacctgagatcgggtaatttatcaaggaaagtggtttaattggcttaccgttcttcaggctgcatagggagcataacatcagcatctgcttagcttctagagaggcctcagggagcttttactcatggtggaaggtgaaacaggagcaggctcttcacatggtgaaaacaggagcaagagagagttgggtaggggaggtaccacacacttgtaaacaaccagatctcacgtgaactcagagtgagagctcactttatcaccaaggggatggcccaagccattcataagagatttgccctcatgatccaaacacctctagccaggccccaattccaacattagggattatacttcaacataatatttgaatggggataaatatccaaactatatcccaaacatggatctcaaagccactatctttattcatgttatggtatggggatgcacaaactttatcccaataaggataatgtattatttcattcttgcattcattgctataaagaaatacctgagactgggtagtttataaagaaaagatgtttaattggctcatggttctgcaggctgtaaggaagcataacagcttctgtttggcttctagggagacctcaggaaacttaaaatcatggtggaaggtgaaggggcagcaaggtgtctcacatggtgagagaggaagaagagagagagggggaggtgctgcacacttttaaacaaccagatctcatgagaactcacttactgtcaggagaacagtgccaaggggggtggtgctaaaccattcatgagaaaccgctgccatgatctgttcacctcccaccaggccctacctccaaaactggggattacactttgacattatatttgggtggggacacaaaaccaaaccatatctttccaccccggctcctcctatatttcatgtcctcacattgccaaatacaaccatgccttcccagtagtccctcaatgtctttttttcttttgtttttgagacaggttctcactctgtcattcagtctggagtgcagtgatgccatcttggctcactgcaacctctgcttcccaggctcaagcaattctctagcctcagcctccttagtagctgggactacaggcgtgagctgccgcacctggctaatttttgtattctttatagaaacagtgttttgccatgttacccaggctggtctcaaactctcaaagcaacccatctgccttggccttccaatgtgctgggattacaggcattagcccgtaatggatcaagcccagctggtctccaaaagtcttagctcattccagcattaactcaaaattccaaagtccaaagtctcatctgaggcaaggctagtccttccacctatgagtctgtaaaatcaaaaacaacttagttacttccaagatacaatggaggtatggacattaggtaaataaccccattccaaaagggacaaattggccaaaagaaaaggactaaaggccccaggcaagttgaaacccagcagggaagttattaaatttaaaaattccaaaatataataatctcctttggctcaatgtcccacatccacggcccactgataaaagaggtggactctcaaggccttgagcagctccacccctgtggctttacagggttcagcacctgtggctgctttcaagatctgacatttaacacctgctgcttttccagggtgaaggtgcaagctgctggtggatctaccattctggggtctgaaggacagtggccctctactcacagctccactaggaagtgcccaagtgggaatcctgtgtgggggctccaactccacatttctcctctgcattgccctagtagaggttctccatgaagcatggagatccaggctttttcacacatcctctgaaatctacagggaggctccaaagcctgaactcttgtagtctatgccttcataggcttaacactacatggaacccaccaaggcttataccttgcaccctttgaagcagcatattgagctgtactttggcccctttgagccatggctggagctggagtgaccaggatgccaggagtagtgtcctgaggctgcacaaggcagtgaatcccttggcctggcccatgaaaccattcttccctcccaggcctccaggcctgtgataggaggagctgctgtgaaggtctctgaaatgcttttgaggccttttccccattgtcttggctattagcacttggctccttttcagttgtgcaaatttctgcagcttgcttgaattcctcccctgaaaataggctttttttttctaccacatggccagactgcaaattttccaaacttttacattctgcttcccttttaaatataaattccaattttccatcatttctttgctaatacatatgagtttagactgttagaagcagccagggcacttcttgagtgctttgctgcttagtaatttcttctgccaaagaccctaaatcatcactcccaagttcaaactttcacagatccctagggcaacagcaaaatgcagccaggttttttgctaaggcacaaaaaaatgacctttgctccagttcctaataagtttctcatctccatctgagacctgatcagcatggccatctttgtccttatcactatcagcatttgggtcacaaccattcaatgagtctctagttaagttccaaattttcccctcatattcctgtcttcttctgatgcctccaaacccttccaacttctgctcattacccagttccgaagctgcttccacatttttgggtatccttgtatcaatgcgacactccatggtatcaattttctgtattagtttgttctcgcattgctataaagaaatatctgagactgggtaattcataaagaaaagacatttaattggctcacagttctgcaggctatacaggaaacatagcggctcctgctcagcttctggggaggcctcaggacattttcaatcatggcagaaggcaaagagggagcaaggcatctcacatggcaggagcagcaagagtgagagggcggaggtgctatgcactgttaaacaaccggatctcatgagaactcactctctatcacaaggacagtaccatgtgggatggttttaaaccattaatgagaaaccacctccatgatctaatcaccttccaccagtccccacctccaacattgggggttacagttcaacatgagatttgggcagagaccacagaaccaaaccatatcagataatttaagaaaaaccatggtaataatttactatatacaatgtataacacagcaaaggtatagagtgatacacattctttaatgtgttttttaataaaagaggaataagttaaatgtcttctttattgcgggatctggccagcagcctgcaatgcagtggggctctctctttgttcccaggtggattggcaggtcgagaaataatagacaaacacaagacagtgaaagctgggtcaaggggggtcaccgccttctggtcctgcggtgccaacaatgcactggatataccagcgtttattattaagtttagtgagggcaggggtaggttagtgagggatttagggtcatttgattatgaggtgagatggtcacatggggatgaagtaattctttaacataacatctgtatgcggaagtacagtatacagggataagaatttacaatatagtgtgtgcatcagtaatttctaacagagccttaaaacagaaacagtctttccataacctataattagcaagatattaatcagcagtaacagttgcagcaaaagctggttacaaacaatccatagaaacaggacgtgaagctagacaactggttagaccagaaattctcagaagggagtatgccttaaccctaaagaggcctagaagagccatggcaagatgagggcgtttatagccctatcttatccatacagacaggcgccccccccccaccccatacgtccgtttataggctctccacaagggtcacattccattcccagagctatgaacatctgcttttctgggataggaatcttggtgatatgaaacctccctgactgcacgtccattcataggctctccgcaaggggaagcacatcacgtgctgttggctcattctggcagtccaacctggcattgtctttacacaatcctgcatgcaactttgtatttacaataatcaggagcatttcatcttttattccatagcaatagtttcagggggtctccctacatcttctgtcattctgctaataaaagaatggattaagccctcaggggctttctttggttttaattgtttttgtatcaaacccaaatatatttttttctattgggatggaaaggattatcccctttaataagaaaacacctattttttcaattgcacctgacttagtcaactccagctggctgtttagaatgtattaagacaaagaaattatacaggaagatttgtcagacaaaaaaaaagctttaaattcacctgcattctgtattttatagctatgatttttacagttacttactaacttccgtactgtctttgataaaggttacgtttgataatattttgttatttatttttatctcactagactgtttagaaatgcttttcaataacacaattttaataaattcataaatacatacaggattattaaggaaatattaataaaacatttcatctaatttaggctgaaaacatacttcattatttctgaagatacagagtgggataatgacttatgaaagaaaaagaaaagccttatgtaaaacatttcacaattaatgtttaagctcttccaaagctgcctcttagccattctgtagggttatgctgatctcttataaacaagaaaattggtttctagatgctgtctggaatgttaatgtccttcaattttatttttatttttttagaggcatctcactctggtgtccagactggaatgccatgacatgatcaaaactcactgtggcctccaattcctggctcaagcaatcctgccaccttagcctcctgagtagctgtgactacaggcatgcacctccacaaccaactaatgtatattctgttgatttgggggtggagagttctatagatgtctattaggtctgcttggtgcagagctgagttcaagtcctggatatccttgttaaccttctgtcccattgatctgtctaatattgacagtggggtgttaaagtctcccattattattgtgtgggagtctgagtctctttgtaggtctctaaggacttgctgtatgaatctgggtgctcctgtattaggtgcatatatatttaggatagttagctcttcttgttgaattgatccctttaccattatgtaatggccttctttgtctcctttgatctttgttggtttaaagtctgttttatcagagactatgattgcaacccctgctttttttttttttttttttttgctttccatttgcttggtagatcttcctccatccctttattttgagcctatgtgtgtctctgcacatgagatgggtctcctgaatacagcacactgatgggtcttgactctttatctaatttgccagtctgtgtcttttttaattggggcacttagcctatttacatttaaggctaatattgttatttgtgaatttgatcctgtcattatgatgttagttggttattttgcccattaattgatgcagtttcttcatagcatcgatggtctgtacaatttggcatgtttttgcagtggctggtaccggttgtttttttccatgtttagtgcttccttcaggagctcttgtaaggcaggcctggtggtgacaaaatctctcagcatttgcttgtctgtaaatgattttatttctctttcacttatgaagcttagtttggctggatatgaaattctggtttgaaaattattttctttagaatgttgaatattggctgccactctcttctggcttataggatttctgctgagagatctgctgttagtctgatgggcttccctttgtgggtaatccgacctttctctctggctgcccttagcattttttccttcatttcaaccttggtgaatctgacaattatgtgtcttggggttgctcttctcgaggagtatctttgtggtgttctctgtatttcctgaatttgaatgttggcctgccttgctagattggggaagttctgctggataatattctgaagagtgttttccaacttggttccattctccctatcactttcaggtacaccaatccaacgtagatttggtcttttcacacagtcccatatttcttggaggctttgttggtttctttttactcttttttctctaaccttgtcttctcgctttatttcattaatttgatcttcaatcactgatatcctttcttctgtttgatcgatttggctattgatacttgtgtattcttcatgaagttctggtgctgtgtttttcagctccatcagatcatatatgttcttctctacattgattattcagctattgaagcttgtgcattcatcacaaagttcttgtgccatggttttcagctccatcaggtcacttaaggtcttctctacactgtttattctagttagccatttgtctaaccttttttcaaggtttttagcttccttatgatgggtttgaacatgctcctttagcttggagaagtttgctattaccgaccttctgaagcctacttctgtcaactcatcaaagtcatcctccttccagctttgttccattgctgtcaaggagctgcaatcctttggaggagaagagtcgctctggtttttagaatgtccagcttttctgaccttgtttctccctgtctttgtggttttatctacctttggtctttgatgttggtgacctacagatggggctttggtgtagatgtcctttttgtttatgttgatgctatttctttctctatgttagttttccttctaacactcaggccccttttctgcaggtctgctggagtttgctagaggtcctctctagaccttgttttcctgggtatcaccagcagaggctgcagaacagcgaatattgcagaatggcaaatattgctgcctgatccttcctctggaagctttgtcccagaggggcacctgcctatatgaggtgtctgtcggaccctactgggaggtgtctcccagttaggctacatgggggtcagggacccacttgaggaggcagtctgtacattcttagagctcaaacgccatgctgggagaatgactgccctcttcagagctgtcagacagggatgtttaagtctgcagaagttgtctgctgccttttgttcagctatgccctgcccacagaggtggagtctatagaggcagtaggccttgctgagcagtggtgggctctgccagtttgagcttcctggccactttgtttacctacttaagccacagcaatggcagacacccctcccccagccaggctgccacctcgcagttcaatctcagactgctgagctagtagtgaacaaggctccgtgggcatgggacccactgagccaggcacgggagagaatctccttgtttgccagttgctaagaccttgggaaaagcgcagtatttgggcaggagtgtcccatttttccaggtacagtctgtcatggcttcccttgactaggaaagggaaattccctgaccccttgtgcttcccgggtgaggcaacgccccaccctgctttggctcaccctcccatgggctgcacccactgtccaaccagtcccaatgacttgaaccaggtacctcagttggaaatgcagaaatcacccgtcttctgtgtcgatcacgctgggagctgcagactggagctgttcctattcaaccatcttgggatggaagccaaactttattttatttttaaaactgtagaagctttgtctcttttcctaagtcagttaactgtactttataaaaagtattttttatctacctttgtaattcatcaaaataaaatacattgaaagaaaaaaatttgcaatgtatctttcttgagaacaccaactatcactgtttttgctaatctatgtgctcagcatatcacatttaatatttgttgaattaaggaatgagggtcaggtaattaagtaacttttccatggtcactcagctttgggaaaccctacttttgaatttactgtttatactatcttaggtctgctaaaattatggggctggtggagccatcttacaataacaaggagtcaaacaagagaaaaaagtcaaatgagtacatgacgctggcttgaaaatcatcaagtttctggattaaggacagcagccatatttattcagaatttctgttataagagaaagatatatcccatctttgtttaagctgttataagacaggttttatgttattgcagcttaaagtatctgatagattctcttctgctcatgagagccacagcccttgttttgctgctcctcgtgtggacaggagtctggaacactggtttagaatagccatgcactagaagtcctgtgtagtcaggaaaaaaatctgttccacatgacaattagggatatagagggttctttgctgtatgtgcttctaagattgggaggcaaggaggaaggaaggaagggacagggatattttagagcaaagtttaggactcagctctaaagactgtgagacttagatatccccaatctattctaaagtctttcaatgtgaccctggatttacaaagcatttacctaagagagaagcccagaggagtatggagaaaaagagatctgagggagataaacataagaagatgcaaaatttacctgaaaatgaggaattcactttcaagttgagtggctggatgggtgagggtgccaactggggttgaagccatgaggaacaatgtcatgatgcaggtcagccatggaggggagccgttgggcagaacaagaaggtttcccatggcacccaagacccataaaacctaagtcaattgcatgtgtgagatatgtctatgtgcatgtgcaaagtaccttaaggactgactgcccctggaactgttacagattctcaaaggggtctggcacctcccaaaaatggtggagaccctcttatgatctggtaaacctgagggactttggaaagcaggtgagcagtcatttcagccctgagtttaggctgcacagacattaaaaacatttgagaaaactatcaaggctcatttatggaacaaataccagtcacagatggttgtagctttttggtgtacctgaaattgtggattcctatcctgatcttacacttatatctcttgaacattgagtttatgtctgcagagtgctgaatatgttactagatattagttgtgactgcttctgcctcctgttttagagaggattgggggtgttcagggctccctcctctatttctgtggttaatagagtgctgaatatgtcacacagagagagctcacatgggttcagagaaccacaggttgagagaagaccttaaacaggcagtctccagttttccagatgaataaatggaggcccaaaattgttatgacgctaacttagtgagaaccaataatttgtttttctgcaatgccaagcctgtgtcccattccgcgtctccagacaggaagggatccctatttagtgttttctaaaaggccccttatatggttgcaccaaccgatggttgtcagaagttttaagtgccattttaggatcatcaacacccacgtccttgcaagagacccccttgggaggcagcagtgatagaaatcagtcatttagctgggagaagataggttggcaatgcagtcatttggaaagccatgtaatttcacctgctgccaattggataatttatattcctctgggtatataaccagtatgggattgctggtctaatggtagttctgcttttacctctttggggaattgccatactgctttccacaatggttgaactaattcacactgttcatgtcctttgccctctttttaatgaggtggtttcttttttcttgtaaatttgtttaagttccttatagatgctggatattagtcttttgtcagatacatgatttgcaaaaattttatctcattctgtaggttgtctgtttactctgatgatggtttcttttgctgtgcagaagctctttagtttaattagatcccatttgtcaatttttgcttttcttgcaattgtattttgtgtcttcatcatgaaatctttgactgttaccctgtccaggatggtattgcctaggttttcttccatgatttttataattttgcattttacatgtaaatccttaatccatctcgagttaatttttgtatatggtgtaaggacggggcttcaatcttgtgcatatggctagccagttatcccaacacgatttattgaataggcagccctttctccattgcttgtttttgtcagctttgttgaagatcagatagttgtatgtgtacagccttatttctgggctctctattctgttccattagtctatgtgtctgttttggtaccagtactatgctgttttggtgactctagccctgtagtctagtttgaagtcagatagcatgatgcctccagctttgttctttttgcttaggattgccttgactcttttggttctatatgaattttaaaatagttttttttttttctagtgttgtgaagaatgtcattggtagtctaataggaatggcattgaatctataaattgttttgggcagtatggccatttcaatgacatttattcttcctatccatgagcatgaaatatttttctgtttaagtcatctctgatttctttttttcactccattttatttatgtattttttattatactttaagttctagggtacatgtgcacaatgtgcaggtttattacatatgtatacatgtgccatgttggtgtgctgcacccattaactcgtcatttacattaggtatatctcctaatgctatcccttccccctccccccacctcatgacaggccctggtgttccccatcctgtgtccaagtgttctcattgttcaattcccacctatgagtgagaacatgcggtgtttggttttctgtccttgcaatagtttgctcagaataatggtttccagcttcatccatgtccctacaaaggacatgaactcatccttttttatggctgcatagtattccatggtgtatatatgccacattttcttaatccagtctatcattgatggatatttgagttggttccatgtctttgctattgtgaatagtgccgcaataaacatatgtgtgcatgtgtctttatagcagcatgatttataatcctttgggtatatacccagcaatgggatgactgggtcaaatggtatttctagttctagatccttgaggaatcgccacactgtcttccacaatggttgaactaatttacagtctcaccaacagtgtaaaagtgttcctatttctccacatcctctccagcacctgttgtttcctgactttttaatgattgccattctaactggtgtgagatggtatctcattgtggttttgatttgcatttctctgatgaccagtgatgataagcattttgtcatgtgtctattggctgcataaatgtcttcttttgagaagtgtctgttcatatccttcacccacttgttgctggtttttttttcttgtaaatttgtttaagttctttgcagattctggatattagccctttgtcagacgggtagattataaaaattttctcacattctgtaggttgcctgttcactctgatggtagtttcttttgctgtgcagaagctctttagtttaactagatcccatttgtcaattctggcttttgttgccattgcttttggtgttttagtcatgaagtccttgcccatgcctatgtcctgaatggtattacctaggttttcttctagggtttttatttttttaggtctaacatttaagtctttgatccatcttgaattaatttttgtataaggtgtaaggaagggatccagtttcagctttctacatatggctaaccagttttcccagcaccatttgttaaatagggaatcctttccccatttcttgtttttgtcaggtttgtcaaagatcagatggttgtagatgtctggtattatttctgagggctctgttctgttccattgatctatatctctgttttggtaccagtaccatgctgttttggttactgtagccttgtagtatagtttgaagtcaggtagcgtgatgcctccagctttgttcttttggcttaggattgtcttggcaatgcaggctctttttttggttccatatgaactttaaagtagtttcttccaattctgtgaagaaagtcattggtagcttgatggggatggcattgaatctataaattaccttgggcagtatggccattttcatgatattgattcttcctatccatgagcatggactgttcttccttttgtttgtgtcttcttttatttcattgagcagtggtttgtagttctccttgaagagttccttcacatcccttgtaagttggattcctaggtattttattctctttgaagcaattgtgaatgggagttcactcatgatttgcttctctgtttgtctgttattggtttataggaatgcttgtgatttttgcacattgattttgtatcctgagattttgctgaagttgcttatcagcttaaggagattttgggctgagacaatggggttttctaaatatacaatcatgtcatctgcaaacagggacaatttgacttcctcttttcctaattgaataccctttatttctttctcctgcctgattgccctggtcagaacttccaacactatgttgaataggagtggtgagagagggcatccctgtcttgtgccagttttcaaagggaatgcttccagattttgcccattcagtatgatattggctgtgtgtttgtcataaatagctcttatgattttgaaatacatcccatcaatacctagtttattaagagtttttagcatgaagggttgttgaattttgttgaaggccttttctgcatctattgagataatcatgtggttttgtctttggttctgtttatatgatggattacatttattgatttgcatatgttgaaccaggcttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggattctctctttttctattcattggaatagttacagaaggaatggtaccagctcccctttgtacttctggtagaatttggctgtaaatccctctggtcctggactttttttggttggtaggctattaattattgcctcaatttcagagcctgttattggtctattcagggattcaacttcttcctggtttagtcttgggagggtgtatgtgtcgaggaatttatccatttcttctagattttctagtttatttgcgtagaggtgtttatagtattctctgatggtagtttgtatttctgtgggatcagtggtgatatcccctttatcattttttattgcatctacttgattcttctctcttttcttctttattagtcttgctactggtctatcaattttgtcgatcttttcaaaaaaccagctcctggattcatttattttttgaagggtttttttgtgtctcgatctccttcagttctgctctgatcttagttatttcttgtcttctgctagcttttgaacgtgtttgctcttgcttctctagttcttttaattgtgatattagggtatcaattttagatctttcctactttctcttgtgggcatttagtgctataaatttccctctacacactgctttaaatgtgtcccagagattctggtatgttgtatctttgttctctttggtttcaaagaacatctttatttctgccttcattttgttatgtacccagtagtcattcaggagcaggttgttcagtttccatgtcattgagcagttttgtcttcactctcttttaaacgctgctcttagttctgtggttgggacttgccagataaataactttatgactataagcttctcagaaaggattgtgattaattttggtagtttatagaatagatttctagtatttttatttcctcttttctaccatttaattaagttagtccataaagcttctgagaggtatgttttattggtgagggggagctcttcaacatttattacagtgatacatgtattcagtcaaagcttaataaatgatagttgagtagtcagatttaatcctgaattctagtaatgtgtccattcccttcttttccctgacttcttagttatgtgtaaattttgaaaaataatgtgaccagtacttgcttagaatcttcaagaggagtttgaatagggatgttttagtttctttgcattttgtctccatttttgacattccaggactaacaaatattctcttagagacccaggcagagtactttcttcttgctgtttctcatgctctttctgggaatgtccacgccttcccttttttttttttttttttttttttttgagatggagtgtcactctgtcgcccgggctggagtgcagtggcacaatctcgggtcactgtaagctccgcctcacgggttcatgccattctcctgcctcagcctcctgagtagctgggactacaggcgcccgccaccatgcccggctaatttttttttgtatgttttttagtagagacggggtttcaccgtgttaaccaggatggtctcgatctcctgaccttgtgatccgcctgcctcggcctcccaaagtgctgggattacaggcgtgagccaaagcgcccggcctgaccacgccttcctatgcaccagggccagtactgactaatatgtttggctttatatcagttgattttgcaaatggtagggaatttgtcaggtcataatgggaaaagacataggtggagtcttgtgcaggcctccttatgctcgtacctcctgtacaggcctccttatgttcatacctcctgtgagcggtcacgtagaacatcctcttcttccagcaacaaaaatgcagcaatgtgtgtgatgtttctgcctgagggaatcactttctgactcagtttagggtttctactggagttggcagcatgagcaccttctgactatcgtgtaccagaaattcagatgcccagaaggatagcaggtgctcagaataaaccatattgtttgcacaaacagttcagggacagtaaacacccttgtcaattggggaatgttaagaacccacctcccccccgccacagccccctcccagatctaagctctcagaaagcagtcatgggcaaagcttacaagcaggcctttttttttttttttaattatactttaagtcctgggatacatgtgcagaacgtgcaggtttgttacataggtatacacgttccatggtggtttgctgcacccattaacccgtcatctacactaggtatttctcctaatgctgtccctcccgccacccccaacccctccacaggtcccagtgtgtgatgttcccctcccggtgttcatgtgttctcattgttcaactcccacttctgactaagaacatgcggtgtttggttttctgttcctgtgttagtttgctgagaatgatgctttccagcttcatccatgtccctacaagcaggcctttctaaggcttgccatgttcactcttttctgcataggagagttggcttagacctcagaaaatggaaacagaattactacggaacctgatgggatagaatgatgaggtgaaaccgacaaggtgaagcctattaagggaaaacaagagccttgcattaaagtctgaaagattgatcactagtaccggatggaggagacacagcttgacagtaactaatgtggaaaacacccaggtgggtttgttccttattatgaattaacaatcttaactgagtcattggaaaactaatggaaacttattctaaattagtgggaatgtcatgcccagatcaatggaggtagaactcccatggtattctgaaatggtcaaacatcatttggacagatgtatgtgtttctaaggtccttatcctaatagagatatgaataaataagaaacatgcagtgggcagtgtgagtttcaaggctgacactgaaagaggagcagtcttagaattttctttttttaatttttaattttaattttattttaatatacacctacatagtaggtgtatatatgtatgagccacatgagatgttttgatacaggcatgcaatgggtaataatcacatcatgtaaaatcgggtatccatctcctcaagcatttaacttttctgttagaaacaatccaattatacccttttagttatttgtaaatgtacaattaaattattattgagtatagtcaccccgtcatgctatcaaatactcggtcttatttattctttctgcctattattttttgaggttttgaaaactttataaatgagtcatagctattctcttttgctctatttgagcagatctggggccaatggtagcagctttggggagacagatacagagtcaatataaaaagcaattgaattagctgactttggcaggaaggcgttctccagtactggaagtattcgtgctgctggatgaacatttatctgtagactggatgagacattgaacctgaagacctgaagattctttctatactctagaatccttgactctatggttaaggtaatttagacattttctgttgtgcctatggcttaaacactgttcaatgaatagtcaaagtccaacaagagtaatctttgtccagagtctttgatttttattctgagtgttacagcagaaacaatcaaaacgctcacgagcactatgggctcattctgtaacatttccttatacagatggcccctaaatttggagacaaaacctttcacattggtgatactcatgcttggaatttccacattcaaaaaaaatcttaaaggattatgtggcaaatatcaaaatagtacctcaaggaaggacactgttaaatttaggtgtgatttcaggggacatcagcaagttccttagtcccaattgaccagaactccttggataaaaccatcaaaacattttcttgtggaaattgaaaatgagttgactttcagaagtccctattgaaaaaaagtgtcctctaggggaggtaatgcttcagagaatatgatgtaaaccaggtgtttctaaactttttgtatcacatatattatcagcagatatatgtgtgtgtatatatatatatatatatacacacacatatatacacacacatttacatacacacacacatgtatttgagtatgtaaccccaatatgtgtctatgcatttatttacatatattcacaactctcttgactccctcttattaaaatgtacttccttaaaacagttacaactctaatcactctagctctctgcctactctgcagctgtgccctgctactgcatttgactggagaaaaatccataaccatatagataggtctctctttaaattcatgctgcaaacctcaaacgggctcttcatgtagctggtctatcagactgttcttctctgatctattcatgctcctctaagtgtatttcatactttagtgtgctataaaccacttggggatgttagtaaatacaatttctgatgctgctgtggaccctgagaacctgcatttctaacaagcttccaggtgatgctgacactgctggcccctgagtaacaagttcctggatgactgttttataccttggcatctctgttcaaacatttaacacctcctccctcatcgctattctcagctactgtcctgattcctacagcattgagaaagcctaagtaatcagaagaggacttcacagtctccatgttatctacacacctaccagtttttggactcgtatactctgcccttccacctgttaataaacattcaaacagaacttgcctaaaagtaaacttctgatgctgtcactaaaatctcttccatgtcccgtgcacccatttcagtggatggcactgtcgctcttccagtcactcaagtaagaagccttgagaaaatcttcttcatgtttctttcttcatgccctatattcaacctcttacctttaccttcaacatagatccacaatctgaccacttctcaccaactccactgttaccacctgctccaagttgcctggatcaccaaaatcagctgctaaatagcctccctgctcctatccttgccctcttagggtctattgtcaaccagcatgagagcaatattggttgttgtaccatatgctattgagtctaagatgcctttatttgtatgatgcagacttattgtacgcgtaagtgacattgtcatgaaataaactatgacattgtgccttaataatagtcttgtgcaaagcatcatttaatcccaccagattctgtctgctttgaaaatgctttcatcaataccaggatattttttaactgtgtctagatgcattctttgattcattgataggcaatcttagcacacatatatcaggaacaaaagaaaacacaagtccatctacttgtggatctatttttttagacttttaaagcacttagttgcttgttgctttccacgaaattatgggtttttaatcatacctccaacgaggaacattcccttcactagtatcagattcataccctactgctctgtttcactgcctttctgtttcaccttaactttcattttaataccaaattgttgtataattttttggatgacatttcataaagcaaataaaatcaacaggtgtagtactgattatgcacagaatttgactgaagggaagaaataagaacctccctgaacaagttcctctgtgcccaggcaataacagctatgtctaaactaatacatgacaaacaacaattttaagacagtttctaggaagataatcccagcaacctcaatctaagatgtgcaaaatttagaaaaattgtgtcttgtaagaggtaaaggtcgataagtcaggtcatgtcacaccctccagggctccctattgaacttgccagagtccttttcatgtcctacaaagtgccatattcactctctgtccccacctgcagcaactatgccttcgtcacagaggagttttgtcatttgaatcgccagggagtattttaaatctagtcaagagcatacaccttgtttggatttctgtgatgtattcatgtgcctcaccactctacacagagtcaagctagttccagctttcccagtgtaagggatagcttccaggaattctcttgcccactgtgctgatgtgagaatgcaaggcctacagtgtttgatgaaaagaacatgtgctatggctcttgcacctggaagtatgtagatagctagagggagggaggcaatcattgaagtgtatagggccaggagccagtctctgggaatatcttctaatcaccggacatataaaatcatgaacagagtggttgatccacatcaacgcttgcctaaacagaagttctgtcctgtaagaaacacacgggaaaggcagcacatccaattaaacactgcaccatacttcaggacttttgaggttttctattttttcagctttgtaaagtgtgtaatttgtcgccatttctttcgtcattctacttaaatatgcacctaattttgtgtttgtacattttaattctttctcttaaagagaagcctgaaattgtgcaagcctcaggccctccaaagcttgaataagctctgctctgatatttgtaccacagccctatctcccccgactccacctcgtccccggacacacatgcccttagctccagccacatggcctccctgctgttccccagccagttttcactggagcttgagatgtataaagaggttggtagagatgggagctggagagctatctctatgtggttgtgagcctatgatgaaggtcttgcttgtgcagcagagggagaagctgaccctttattctgtaatttgggaggtgttgaaaggttttaatccagggagtgaaattttaacatacgctggcctctgcactggtgattgcatttgtctggagccctcgtcatccagacatctacattgcttgcttcctctcctcccttttggaaagacttttcctagaatttactttgttttaattttctctttactatagtattttttacgtcgtaaggtagatagataggtgggtaaactgattgatagatactatcaatatataaccatgctattgtgcttagagtttattgcctgtctctccactagaaggtatacaataaatactaagtgaatgaaactctcttcatatcaaaatctgtaaattagtcacttatgtaacatagagatatttactcttctaaccaaaagtgaaaacaatttcttcttggccctaaagggaacccttcactatgctttgaagaaatttaacgtcaacatgatagtctgagcccaggaatattcaagtgtgaagaaaatgtgaatcttcaattgaaaagcccacagggaaatattgcagtattcagttgtagtcagtggttgcagattcctactgccagaaaatggcagcaggatttttacagttgaatgactgcatgaaaataagcacaagctgccttttacagggagcttctcagaagcatagctctgacttcaggaaaccacagtatccatactatcttggtccttatctacaacaatgaggaaaatgagtacagcagaaagtgtggaatgctatgagcattaagccaggcatttgaaatgattgtttattaacttctctctgttctggattttttggggttttatttttcctgactgagaagtgggatcacttttctacatcttcatggcacagttgcatcaagggctacctttccacttcagtgtgggaggagatggcaacaggaccctcacagatgttcatttggcttaagtctcagatgttcacacttcaggaaaagccttcctccttgtcttcagcaaagttacagttaatgtctatgtctcttttgttggcttggctgcctgctgcttcaggcaacttctgccactgtgtgaaaggctggatgagaggccatgtttctttttttgctgaaacaaaagaaagattcaggcacaatgctttcaccttggctcagcatgtagaccgagtgcacctacatatttcacatagatattctgtggaaactttcttttcaagagcaagcatctctgtgtaatcggaaaaaaaccaattaacttttctcctactatactctcaacacgcaatactttcagcacacttcagttctgacaccacactcaacaaagaacatttctgctaaccaaatgcatgaattttttctcatactaagcaattcttcaataccagctgggtgctcctaaagtttgactctattctgacactatctacctagagatagtgttcagatcccacaggttaaaggctctgtcccacaattttgctccccacttcatgcgccaattgcaagtagtgaattctcaggttacccacaatttctggccagcctggatacaaattagagatttccacaacccccttctcaggctcaatcatttgctagagtggctcacagaactcagagaaacactttacttacgtttactgattcattataaaggatacagatgaacagctagataaagtgatatataggtaaggtatgtgcaatggggtgcaaagtttctatgccctcttcaccatgtcaccctctcagcacttccatgtgttcagaaacccagaagctctccaaaccccatagtttagggatttttacagaagctttatcacatacacatgatcaattattaagtcagtccctagcccctctctccttcctgggagatgggggatgaagctggactagccctctaatcacagcttggtttttctggtgaccagttcctatccaggtgtcaaccatgactcaccttattagaacaaaagatactcctatcaccctggaagttccaagcgattaggaactctgtgtcaggaaccaaggtcaaagaccaagtatcagaacaaaagatgtaactagcactcctattagtcaggaaattacaggggttttggagctctattccaggaactggggacacagacgaaatatatatttcttattatatcacaataccacaatctcctgtaaagatcagctgaaaaataaaatgtgggtgtcagcatggtaatacatttataatacaaacatatatttgtagctttgattcatgtctcatcctgacctatggcaattgtcagtgagctatagctgtctagtcacagcttagtggactggcaaggagggactctgatgggcacaggcccacctgatggcttgtggggcaaggggagggaccacatgtgtcggggcttgtgaggctggtcctattaggtttgttcttctgttcattcaagtgaataagacatgtgtctcgctccttctacccctagctctcacagtctactctcagcacagcagccaaagaaatcctgttgaaactggaattggatcataatcactccactgattcacaccctcacttgggtcctcatttcactcaaagtaaaggaaaattattcacaatagcctgcaaagccctccttgatctgacccattacctgctcttacctagaacccaccaggcacatttcttcctcaggtgtttgcatttgctctcctcactgcctggaactctcttcccacagatttctttatggtgctttccctcatcctctacaggtctctgctcagaagtcagcttctcactgaggcttaccctgaccagcactttttattttgcacccccacacagttatatacccagttcaattcttctttctatatcttatttgtctgatagtcctttattactatctaacattttatagtacttttttctttgtttattgtttgtcttccctagtaaaatgtaaaactccaagagagcactaatttttgcctggtgtgtgcttttcactactctaatccaggcccctggactatcagttggaatatagccaaggtgagcattcatacagatttgccaggacagttccagttatgcctattgttctggcaggattattaatgacagtctcttcactgtcccaagtgtttttgcttaatttatggtcaccctacacagaagaaatgctcggtaaatatttttcaattgaaagactgctccctcaggggtagaactttgtctagtttggttcaggcaaagagtcagtactaggaaagaagcaaaattcctgctgctatgaaggagccaagactcagaaatggtagtagagaagagcagttggcatctaaaaggtgagtctttggactgtagtccatcaatctctgacaatcaggagcagagttccaatcctcaagaaagagtacagtggagttgctgctcttgcaaaaagacttagggactagaaggttgactggagcagaaatatagaatagcatccaatgcagaaatacaactttttaagctggggctaaagagggcaatagccagataatcacaaattcagttaaaatcccagctaattgcccagctaattgttaagaatcccaggattcataagactttactctcttgaataaacactttgaacccattacatatattcaaatcattcttttcttaatgaattctgtggctcttgataggattcaggacatactactccaaaatatggcacccaggcatttgaggaaatagcagaagcaagcaataaaagctaaaaagaattcccctttgttccttttcccctaaatcaagccataaaacctagctgagttttccttgaaaataggtcataagactcattccagaggggtcctgccctatgccggaggaaaggaatgtcacccaaggatgccaagaagaatctgaacaaacaagccttgctacatttccaccccctaactccaaagtttattaccattaggtcataccctttttttttttttttttaggcagagtcttttttttttttttttttttttttttttttttttttttgagacggagtctcactctgtcgcccaggctggagtgcagtggcgcaatcttggcttactgcaacttccgtccccccaggttcaagcaattctcctgcctcagcctcccaagtagctgggattacaggcacccgccaccactcctggctaatttttttatgtttaatagtgatggggtttcaccatgttggccaggctggtctcaaactcctgacctcaagtgatccgcccaccccggcctcccaaagtgctgggattacaggcgtgagccacctcgcctggccccataccctcattttgtccaatcatgtttctctacatctacccacttcctcattagacttagcataaaatatacagttttctctgggtctttgagtcttcatttctgaagcctcccatgttacataaaacttatattaaataaatgtgtatgcttttgttttgttaatctgagctatgaactttgtaatgggtaaggaaagaaatatttttccccctgtactcctcttcagtttacctagttacccttttttccaaaacatgattttaaatatcttttaaaatgtatatttcactttaatttctgttattctctgtattagttttctatgactgacctaacaaattcccacaaatttatcagctttacagtatacaaatttgctatttcacagtcacgtaggtcaaaagtatgggctggatcagcaggtttctatgctcttggtcccagaaggctgaaatcaagatcatggccagcttggacacttctctggaggctctgggagatctgtcaatgtttccttcatggcccaggatgtggaaggtgctattactgatttgacaagaaatggcaagtgcagaacaaaattaagaggctaaacagcaaccgtgagccctctctacacagtgagcttctcctttggctgaatttggatgtgaagctggcaatctgtccaaccaatcagagagtgaataaatttattgtgagtgaatgtggcaggcatagggaaagaaaggggtcaaggacatggttgaactcatacatgtgcctggcctctaaaaagaatgaactccattagagtcatactatctctgctcttcctgtaaattgtgctataaaacattgacatatgctgagaccccatccttaaatactaaggttgcattcactgtgacagggtgattattcatgaacatgtgattagattgaaaaatattgtattaaacatccctagatgagcatcttgttgttactatattctgtttccttcagtaggaataagtttgattaaatgaagggcttggagacttgggtggagcaagatggtagaatagaagtttccaccaatcatcccccctgcaagaacaccaatttaacaactactacacaagaaaaggcaccttcataagaaccaaaaatctggtgagcactcacagtactctttttttatcttcacatcattgaaagaggcactgaagaggtaggaaaacctgtcttaaactgcctatgccacccttcccccatcccctagcattgacagcatggtacagaaagcatttctgtgtgctagggagagagagagcttagcaattgtgaggcattgaacttagtgatgccctgttatagcagaaaacaaaactacatcaaactcagctaatgcctggcatttaaaggaccatttaaaccagacttagctagaagggaatcactgatcctagtggttcaaacatgagttcctgcaagcctcctgaccacaggcaaaagtgccctgggtccctaaataaacccgaaggcactctaggccacaaggactacaactcctatgtgagtcctagtactgaactgggcccagagccagtggatttgtggggggcacacaacctactgagacaccagccagggtggctaagagactgttggcatcacccctcccctaactccaggcttcacagctcatggctccaaaagagaccttttccttgtgtttgaggagaagaaaaggaagagggggaaggaccttgtcttacatcttgaataccagcccaaccacagaaagataaggcactgagcagagtcgtgaggtccctgttccagttcctagttcctggacaccccttccggcccaggtgtgtctagaaatgtcttgaaggaaaagacccagtcctggcaggattcatcatgttaactgaagagcccttggaccctgaataaccagcagcaatacccagatactactttgagggccttgggtgagactttgagacttgctggcttcaggtgagactcagcacattcccagctgtggtggctatgtgatgagactacttctgcctgagaaaaatggatggaaaagtaaattggactttgtcttgcattttaggtatcagccacaagggaggtagagtactaaacaggctttgggggcaccaattccaggatttggctcttggatggcatttctgcacctgccctggcccagataggagcccgctttcctgaagggtgagtcctaggccaggcagcattcaccacaacctgactgaagagctcttgcaccctaaaggaaaaaacattggcagtagtctggcagtacttcctgtgggcctgtggttttggtggtctcaggatgaggcttcactgcctttggaaaggggaaggaagagtggcaaggactgcatcttgtggtttgagtgccatctcagctgtagcacaatagatcaccaggtaaatatctaaggttttcactctagtccctggctctaagacatcacctctggacctgcctggggcttgagggagctagccaccctgaaaggaaggacacaggcctatctggctgtgacacctgctgatcgtagagccccagggccttgagcaaacataggaagtagccaggcagtggttatacaaggccttgggcaagacccagtactgtgctgtctgaccgagtgcagtctgcgtggtggtggctacaggggttcttgtgtcactccactcacagctccaggtggttcagaacagagagagagagagagatgccatttgtttgaaagaaagcaagggaagagaacaaaagtcttttccgggtcatccaggaatttgtcaagatcttgtctgaaatcatcaaggcagtacctcgatgagtctgcaagaaacacagcattacaggacttggagtgccccctaaagtagatacagcttagatcacaacacctaagcccttctgaatatctagaaagccttcccaagaaggaaaggtacaaagaagtagagactagaaagtctacaataaatacctaactcttcaatgcccagacactgaagaacatctacaagtatcagaatcatgcaggaaaacatattctcatcaaatgatctaaataaggcaccagggaccaatcctcaaaaaacagagatatatgacctttcagacagagaattaaaaatagccattttcaagaaactcaaacaaattcaagataacacagagaagaaattcagaatgctgacagacaaatttaacaaaaaggtcaaaataaaaagaatcaagcagaaattctggagctgaaaaatgcaattggcatactgaagaatctgagccttttaaaagaagaattgattaaaccaaagaaataattagtgagcttgaagataagctatttgaaaatacagtcagaggagacaaaagaaaaaaagaataaaaaacaacgaagcatgtctacaacatctagtaaataactgagcaaacttaacatttattggccataaagaggagacagagaaaaagacaggggtagaaagttcattcaaagggataatagagaacttcccaaacctagagaaagatatctgtatccaagaataagaagacaatagaacaccaagcagatttacctcaataaaaagactacctcaatgcatttaacaatcaagctcccaaatgtcaaagataaagaaagagtcctaaaagcagcaagagaaaagaaacaaataagatacaatggcgctccagtacatctggcagcagacttttcagtggacaccttacaggccaggagagggtagcataacatgtttaaagtactgaaggaaaacaaaaaaaacttttaccctaaaatagtgtatctgctgaaaatatccttcaaacatgaaggagaaataaagactttctcagacaaacaaaagttgagggatttcatcaacaccagacctgtcctacaagaaatgctaaagtgagtactccagtcaaaaacaaaaggatgttaatgagcaataagaaatcctctgaaggtacaaaactcactggtaatagtaagcacacagaaaaacacaaattaatataacactgcaactttggtgtgtaaactactcttatcttaagtagaaattctaaataaagaaccaatcaaaaatagtaactacaaaacttttcaagacatagacagtacaataagatataaatagaaacaacaaaaagttaaaaagtggaggggcaaagttaagggatagagtctttattaattctcttttgcttgtttgtttatgcagactgtgttgttattagcttaaagtaatgagttataagatagtatttggaagccccatggcaatctcaatgcaaataacacgaaacaaatacacacaaaataaaaagcaagaaagtaagtcatatcaccaaagcaaatgaccttcactaaaaggaatacagggaggaaaaaaaggaggaagagaaaatcacaaaacaagcagaagataacactccatgtcaatggactaaactccccaatagaaagacatagagtggctgaatggataaaaaaggcccattgattggttgcctacaagaagtacacctcacctataaaaacacacatagactaaaaataaagggttggaaaaagttataccatggcaaaagaaaccaaaaaaagagaaggagtagctatacttatatcaggcaaaataaattttaagacaaaaactatagaaagagacaaagaaggtcactatatagtgataaaggggccaactcagcaagaggatataacaattttaaatatatatacacctaacactggagctcccatatatataaagcaaatactattagtgctaaagagacagatagactgtaataccataatgtctagagatttcaacacccaactttccactttggagagatatcccagccagaagaaaatcaacaaagaaacatcagacttaatctgcactatagatcaaatagacctaatacatatttatagaacatttcatccaagagctgcaaagtacgcattcttctcagcacatgaatcattcgcaaggatagaccatatgttaggtcacaaaacaagtcttaaaacattcaagaaattgaaataatactaagcatctctgatcacaatggaaaaaaactagaaatcaataacaagaggaattttggacactatacacatatatggaaagtaaacaatatgcttttgaaagacgagtgggtcaatgaagaaactaagaaggaaattgaaaaattttctgaaacacatcataatggaaatacaatataacaaaacttatggaatatagcaaaagcagtactaagaaggaattttatggctaaaagtgcctacttcaaaaaagaagaaaaacttcaaagaaaaaactgggtgatgcatcttaaaaaatgataaaagcaagagcaaaccaaacccaaaattagtagaagaaaagaaataagaaaaaaaggagcagaaataaatgaacttgaaatgaaaacaatacaaaagatcaagtaaacaaaaaattggttttttaaaaaaactaaataaaattgacaaactgttaaccaaacaaactaagaaaaacagagagaagatccaaataattaacatcagatatgaaaaaggagacattacaactgataccacagaaattcaaagtatcattagtggctactatgagcaactatatgccaataaattggcatatctagaagaaatggaccaattcctagacagatacaacctaccaagattaaaccatggagaaattttttaaaaatgtacacaccaataacaattaacaaggtcgaagccataataaaaagttctttagtaaagaaaagcctgggctcaaatgcttcattgctgaattctatcaaacatttaaagaagaattaataccaatgctactcaaactattccaaaaaatagaggaggagggaatacttccaaactcattctattaggccaatataaccatgataccaaaaccagacaaagatacaacaaaaaacagaaactacaggccagtatatctgatgaatattgatgcaagaatctgcaacaaaatactagcaatccaatttcaacgatacattaaaaagatcattcatcatgaccaagtgggatttatccctgggatacaaggatggttcagcctacacaaatgaatcatatcaacagaataaaggacaaatccatatgtttgtttcaatgaatgtggaaaagcatgtgataagattcaacattccttcacaataaaaaccctaaaaaaaattgggtatgggaggaacatacctccacataatgaaagccatatacaacagacccacagctagtatcatactgcatggggaaatactgaaagcttttcctctatgttctggtacatgacaagaatgccaactttcaccattgttattcaacgtaatactggaagtcccatgagattcaatctaccagattgctctagaacaatcagagaagagaaagaaataaagggcacccaaattggaaaagaagaaattaaattatccttgtttgcagatgatatgatcttatatttggaaaaacctaaaaactccaccaaaaaactactagaactgataaatcaattcagtaaagttgcaggatacaaaatcaacatacaaaaatcaatagcatttgtatatgccaacagtgaacaatctgaaaaagaaataaaaaatgtaatcccatttacaacaaccacaaataaaattaagtacctaggaattaaccaaagaagtgaaatatctctataatgaaaattataaaacactgattaaagacattgaagaggatgtacaaaaaatgaaaagataccccatgttcatggattggaagaatcaatattgttaaaatgtctatactacccaaagcaacctacaactttaatgcaatccttaacaaaataccaatggcattcttcacagaaatagtaaaagcaatcctaaaatttatataaagccacaaaaggcccagaatagtcaaagttatccaagcaaaaagaacaaaactggaggaatcatattacctgatgtcaaattattctacagagctatagtaaacaacacagcatggtgctggcataaaaacagatacatagaccaattgaacacaatagagaatacaaaaacaaattcacacacctaaaataaactcattttagacaaggatgccaagaacatgtattggggaaaagttagtctcttcaataaatggtgcaggcacaactggatatatccatatatagaagaatgaaaatagattcctatctctcaccgtacacaaaaatcaaatcaaaatggattaaaaacttaattctaagacccaaaccatgaacctactacaataaaacattggggaaactctccaggacactggtctgggcaaaaacttcttgagtaataccccacgagcacaggcaaccaatgcaaaaatggacaaacgggatcgcatcaagtttaaaaactttacacactaaaggaaaccatcaacaaagtaaagagacaaccaactgaatgagataatacatttccaactacccatctgacaagggattaataaccagaatacataaggagctcaaacaactctgtaggaaaaaaaagctaataatctgatttttttaataggcaaaagttttgaatagacatttctcaaaagaaggcatacaaatggcaaacaggcatacgaaaaggtgttcaacattattgatcatcagagaaatgcaaatcaaaactacaataagatatcatctcacccccgttaaaatggcttatatccaaaagacaggcaatagcaaatgctgggaagaatgtggagaacagggaaccctcgtacactgttggtgggaatgtaaattagtacaaccactatggagaacactttagaacttcctccaaaagctaaaagtagagctgccatatgatacaacaatcccactgctgggtatgtacccagaagaaaggaaaacagtatgttgagaagacatctgcacattcatgtttgttgcagcactatttacaatagccaaaatttcgaagcaacctaagtgtctttcaacagttgaacggataaagaaaatgcggtacttatacacaatagagtaatatttagccataaaaagtaacaagagcctgtcatttgcaacaacatagatggacctggaggtcattatgctaagtgaaaaaagccaggcacagaaaggcaaactttgcatgttctcacttatttgtgtcacctaaaaatcaaaacaattgaactcacggagacagacaatagaaggatgtttatcaggttgggaagggtagtgagggggtgaggatgagatggggatggttaatcagtgcaaagaaatagaagaatgaataagacctattgtttgatagtataacagggtgactatagtcaataataatttaattgtacatttaaaatgactaaaagagtataattggattgtttttaacacaaagaataaatgcttgaggggttggataccccattttgcattacatgattattacacattgcatgcctgtatcaaaacatctcatgtacctcataaatatatataccctctatgtacacacaaaaattaaaatttataaaggctcaataatttagatccacttttttttttagaatgaacctttttaatgccctgcttgatttttgttatccaacctttactcatggtaattttatgagaaaccatggcagtatttacttgaataacagtgacccatatactaaaaatgaattactttagaaattgctattttgggaacaaaactctctagcattctcttcagaaatctagaattattctcaccagaacatgtctctaatctcatttttaatcagagtcagtcactggtataacacaacataaaactgtcatttataaagtaaaaattgcagacaaaataattttatttatatatataaatatatagatacaggtatccatatacagacagtgcctgttttctatgtaattatagtattctgatcagagtttgttttcatgtgaacacaagtcctttcacttactctggatctaaggatagatcagatcatttccctgtctacattcctggaatagataggagaagatgccacaaatttaatatttatttgaaataacatttatctaaaataattctctcaggtacttatctccccttacccagctatctaactacttgtaggtttggaggtgaggaagtgaaaggtagcacaggggaagcataattgttatttgcttgaaggcttatatagttatcttctcttctttttctgataaatgccacatcacaaattcatcatttcatttcgagtggtgctatgcacatggttgtattgttgtaaagttgctgctggtcctgctagattgttttacattgaagtggagaggggggaaaagaagacaaggagatgaggagtacattctgaaccttttataggatatttatacaccttaaattcagaaggatgatatttcatcaaattttttcagtggccttttttctatgtataaacatcccataatgtttgcttacatattgatttagttatagtgaactttgtttcatgccattaaactgttacatgttgaaataatcagggtaaataaagtatatcaatgccattttcattatttgtctaactcgattttatatgtgtttctatgatagagaagattcattatgaaagttaagatcttggttctgtggtattctcttttgcctgcattataccaggtataggctgcatctgcagcttgggtcctactgtatggacaaaagggagtaaaacacaatcttctcgaaaggatcatgtttaaacacaaacagtataatacctttcttgtacaccgctgagatttcaagattgttatggcagtatgtactagactaatctcaccatttactttataaaccattttttttgtaaatgaaattgtgttttcatttactacatttgcgttttaaaaaatccaataaaaatattttactgctgcaatacatagtctacctagtttatattctggataaaaccaagtttatatataagacatagttaaactgcagtgtacttattctaacacagtctgtaatgctcagtaataatatttggatccagtcttaactccagttactaaaatgaatatttgaaaaattattttatttttttctttttttgttttgactttaatttgacttgacattaataaatgtagtttcaaatactgaataaaagtcctctcatagacactttgatgggtacattaaatctttgaagccatactcaaaaaatcgtaaacatttataaactgttgtttcaaaacaaataattaaaagtatttgatatatacacaatggaatattattcagccataaaattaaagaattaaatcctgtcatttgcagcaacatggattgaactggaagtcattatgttaagtgaaataagccaggcacagaaagaaaaatattgcatgttctctcctactttgtgaaaactaaaaaagtggatcttatccaagtagagggtagaacattggttaccagaagctaggaaaagaaggaggaagggggggggcatgaaaagaagttaatgaagggatacaaaaatatagttagaaggaataagttctagtatttgatattatagtagggaaatcatagtttataataatttattatatatttcaaaatagctagaagatttgtaatattcccaacacaaagaaaagataaatgtttgaggtataatggttatcccaattaccatgatttgattattacccattgtgtacaggtatccaaatatcacatgaaccctaaaaatatacatacctaatatatatttatatatatatgaatttgatagttagcagtataaaaagcaggaataaacctgaaatgaatcatttcaaccctgactgcaaatgatataaatttgatttttttagtctttaatatttacacaactagtacagttttccaaaaccattatcataagcagaatgacctaattttcagatatttctgtcgtctaagagagaactgcatataaaggccagcttcattcccacttcaggaaaatcgataagtagaatttttttcctgagttgtttgtatcatctgaaattcataaatatataattcctaatgtacatttttctataatgcattttgttccaggtattcaatgtgtgtgtacatatatttgtattgctttaattcaaagtaacccctcaaaaatgtactttgactagcaagtatgtttttgagaaagtctataaagtttactgggttgcaagcatggattatagattttattttaattaatatggatagtaccagctatacaatgcaatgtttgtatttaaagccaactctgactcatccgtggtcatgaaaaataatagtaattacaataatttctaaaaggtactaagcagagactatactatgtgctttatacatttttaaaatttaatcctttcagtgctcggaaggaggagctgttatttttctccccattttacacatttgaagattggggataggttaaaggacttacccagggtcacacagttagaaagtggcatagaaagcacttaaattcccatctccctggcatcagaattggtattcataaatcccaccctattctcaggaccaagtttcctttgtgtgcaccaagcctcacaaaaagaaataggacaattttgattatccggttgaacttactcacctgggattcttgaataaataaaaatttaaaaggagttacttagggccaaagtacatccaagaagtaagagtaggtatgactgagcctgatataaagatctgcatttaaagtatttaagtagtaagtagaaggctttcacaagttaaaagaaaaacaaacaattgaggttaattataattaggtgaattctttatgttaaaggagaaataacgataaaaataattaagttaaactgatatgtatactaaaagcttgtttactaaaattgagatgagcagcaaagaatatgtagtagcctcaacttacctatcaaaaagtgaactttactatgccataaaacttacagtagccagagtgtcataatcggatttcagttttcgtaggatcagagagaaattacattttaactctgattaattccaacatcttgttaattgcatactttgacaatctagttcatgagaccattgacagaatgtaagatcaattgtttttattgaagcttttccaattctattcccttcataaaaataagctgatacattatatgggaaaaatctatatttgtaactagaaaacaaactgctaagccagtaactttgctgaggcaggtagcctgcagtataaagggcatttatttttaggcaaactgtaggtgttcaagaatttcctattggcaaaggctatcttggttagccactgtgcagaaaagagttgagataccatgccttagcattctatcctaagaaatgtctgcttgtaactttgggccttggctggcatctgataacttggatttcaagagagttcctaacattcccagaactgataaaagtggctcattgcgccaaaactgtgtgtacaaccaatgtggtttatgctgaacccctgctttccttcttgtctggaaatttggtgcatgatacctacatgaccagcctccagtcaaaatcctgggtgctgagtctctagtgaacttccctgtgcagaaacgtcacacacatgttgctgcatttttttttttctgggggaagagtttgctctgagtaacccctcatgagaggaagagaacatgaagaggctagcacatagatttgtccacattctgcctgaatcttttccctttatgatcaggctgtataattatactatttctctagtaaatcttccacatatgtatgattatttgctgagtcccatgagtttttctaatgaatttccaaacgtgggggggggtctcagagacctttgacgcagccactttccataggcatcttacttccacagactttaaaaagcagtacagggttaatatgttccatcagaaatttgtggagagacttggcatttggcgactgtgctgataatataaataaactccaaatatattcgcaatatgtgatttcaatacatcactttgcaatgggcattttgcacagtgaaacggaaggaaatcaggaaggcagtggatgtacacagcagaaacaatagtggacttttaaagaaaaataagcacaagtgtcattgttcttttatccttagggcacaattattctttgttctgagaaatgtgagaaaaaaaatctaagaagccatgtaaagatctcttgtggacttccaaaaataccagctgagggagaaagtaggcagagatagaaaggaatcatgttattaattaatgctgtctttcaaaattacagaaaccacgtttgctacattgtcggtgtgttctgtctgctctttttttcagatgtaggagagctgttgaatatttgtgaacaaaggaagcaaaaatattcctactctatgttttgaaattgaattgaaaacagaaaagaagaaagcagggtgttcaaacagatcatcacatcaaaagaaaatattcctgctatcagattaaattaaaatgctgattccataataaatatgtcacaaagagctactgtaacacaatataacacgttggagacaataactccatgtacatcttttaaacaccactgtaattcttttctcatcctttaaaccaatgtgatttttttagagtgagtaaaatgtagtgttatgacagtgttgaacacatttcatgtagtttcacagagcatttccagaaaatgagtagcaatttaagacagagatttaatctattgagagtatgtctccaaattattttcctattctttaagattcctgtgacatttatgcatccttggcatctaccccctttatttttcccctctccatccacttactacgttatgtcaccttatttttttcctacaaattaatggcttcttaatggagaagaagttaacatactggccttaaggggaaatgcaagaggatagaattcaaagaaagctaatgagaatgataaacagtttgaggactgtagatttttatcattatcataaaattactctaattgtaatggcaagcctattaaaatgatctgtcattaaaattgcagtgctgtggcaagtaattttgtctatcaaataattttaatattgtcctaaaatgatactgtttcaatgctctcagtccagttagaatatataaatcatttataacaatgacatttttgtttctgttacactcttcttaataaagttgtatggatttggcttcacaaaattttgactttaaactcttttaagaaagggaaatgaattcatcactctttgcttgtacttttatctgcacattccccgactcttcccagtgcttactccataataggaatttgaaaggggaaaatgtagggggttataggaatactctactccttttggtgctatgttataaaaattgtttttcctttttaattcataattgacaggagaactacaactgtaatgatttcaattctagaatttccattgagttcttttttatagtttgatttctctgctgagattccctgtccttatattcattgtgagagtatttttatttactttcctgggcatagttaaaatagttcctttaatatccttgcctaacagtttagacaattgcgtcatgttagggtttatctccgttgattgccttttctactaaaaataaaatgggccactttttttgttttattgagtaattttgtgttttacccaggatattgtgaatgttatgttgtggagactgtagattctgttataccctcctgaagagttgatttcgatgtggttttgtcggcttgtttttttaatcaggcacaacatttggttggtctcaaagtgcgtggtccattttctgaagcagcaacagttcaaatttcagtttatttagatttagccgtgttaacttgagcctacctggcacatttgtggttcagccacagaaatgaagaaagtttatagagagaacttggcacactccccctctgtctccttttccgtgtcactccctcactttccctttcctgtggtttcccggaactctgtcctctgaatcttcaggccaggaatactacaagttttctatcagagtttcaaccactccgtgtagagccacctttgttttgtcctaacgctaaatggtaaaaaactaaccctatcccctgttctttcattcaagtttcgagtctccttttggatattttcttccaaaattttgttttgttttgttttccgtggcagggttggatctggtagagctactcagctatactattaataatagccaaactctacagctctatgtgatttcaaatattacaattgtaaaataaactttgtgactgtaaaagtttctgtgctgtttttgctagttgctagtcagatgttataataaaataatttaaatcattaatacagctaataaaggtgagcctaccaaatacagcctttctataagctatttaaagttttgaaatagaatttttcagaagaccataaaacaaaaataggaagtaaatggaaaaataattacttggtaattcacattataaattaaggatatctgagagacgaataagtggcattacagaagccataaggtgagaagtaaatgaaaagactgtgaccttgattctaagtcattggagataaagacattgtaactcagtgtacattttctccctcaaagtctaatgtgggttggcaggggctttcctacatttggtgactcaggaatccagcttcccaccatcttgtgatggtgccatgtagacatgctacctccataacctttgctacaggggaaaagagtgccagagagttgtatgcagccattttacagctagacctggaaatgtcatgccacttctgcctacctctcattggttagaactcagtgaaatggccctaatgcaactgcatctgcaaaagaggctgaaaatgatgttcttttgtgtgtctaggaaaagaaggtagtttggtgaacaaatagcatgtctatgccacattctccttttaatcaagtctagcagcagaagtaaaaagacatgatttttactccaaatttctcttctcaataagggtagagatagtactttctttccacagaaagaaacttgctactttttgtgcaatattaccaagaacattgagagaaacaagattacctcagaaaaaagtatttatagagtttatttaaagggagcaaaggaataaagagtaatatctttatttataggcagaataatattttgggagtttctggcattttaaatgtcattgctgctccctcttagtagcagtcttcttagcaacctgctctatgttacaacagcaatatagaatgtgtggttgttgtataagagataaagggtttgtgatttctgcgtttttacaaaggtaatctatagcctacatggaggttaggagcactggagacctgtcactgagagttggtgcagctggggctatattcatactgattggcctttatccccaaggaggctggcggcctgctttgatctttcttatgtctctctgtcttggcatgtaagagagacctacatgtaatccattcagaaacctcaaagcctgcaaggtcctccattgattagattactggatctctccttaaaagcattccctgcattagattttggacttattatgcatccattgttttactgttacagttgactttattattattattgttttatttagaagatcttagctaacttccatagaggtttatctggttggtttctttaactgtctaaactcttttttcaattttatttagttagtacttaacatatttagttttatttttaaaactcctttcatacacacataaagacagggagagaagtagagagagaaagtaaaagatatatatagtatggtatttttgtagagaaagtatcaaaaacgatttttccaaaaaagccaacatctcttctacaatagataattttagcaaaaaaaattatattatttttagtctatagcattttctactatagaatttatgtaagataaagtatatgaaaaataatccccaatagtcaaaagataaacaaacataactcataatcccatcattcaatcactatttaatatttagaaaactttgcactgagaatttaatgatgtttataaatggatagagagcaaattcagtataaaatcaagaacagctggttagctgagtaggtggttcatagaaatagagtgggagatttgagacattgacattagaagagcataaagcaatcaaatgattgaaacagagtgaaaatgttataaagatatgggtttaaaatatttaaaaggaaaagtaaaggaagtagtaagccacaagcaaaattccttaaatcaagaagaatccctcttgctagttcattgatggaaaaggttagagatagtttattagctttcaatatagaaaaaaaaataatgtcacccctaaaccaagtaacattacccctaagagcccactgggacttcagcatagccaaagtgagtcagagttttcttcccaactgaaatgaagagcatgaggtaaaactaattaatctaattttatggtccaagttggggaaagagcaatctggcaatttcctcactggatgcaagaaaaataagttattctgtttatttttatcttagttatatattttatatgtatgtctagcatctttttttcatacgagtacttccatttgggattgataacagagaaaaatgcacactcaggctagattttacttattattgaattcaaaattgaataagaaatggctgtaaaagctcaagaacttacacagagtcattaaataatatgcaggggagcataattgagagaacgcaaggaagaagatagggaagaagatgaaaacaaaggagggaaagagggaaggcatgtgagaagtagggaggatttttctttacaattcaaatagatgttgtttttaaaggaaatgggccatgtatgctacaagttcacaaattcaatctgaaaatctccattaccaaagttcttaaattgctttcaaaagagattactgcttattttctcatagtttaggcattctaggtataatccctgcttaaaatatcaatgtgattaactttttagtttacttttggaaatttgtctctaatcaagccaagtgtagccaaccaaataatggtcactaaaggtatacatgtcctagtctttggaacttgcaaatatattatctaacatggaaaaagggacttcataaatgtgattaacttatggattttgagatggtaagattatactggattcttcaaatgggccttaaacataatcacaaagggtcttacaacaaggaaaaagaagagatttggtgacagaagaggaaatgtgacaatggaagcaagaagttggagtgatgtgaggaagaggatgaagggaaccattagccaagaaatactggcaacttccagaagttgcaaaaggcatagaagcaaatcacctgatgaagcctctagaagaaacacactctgccaacatcttaattttagacttttttggactttagacagttctgagctccagaactgtgagatattaaatatatgttgttttaagtgtctaagtttgtggttatttgttacagcaacagtaggaaataggaagtaagtcagtttgaatagatctgaaagctttagaaaaggctattacatacatataatataaggctatatatatatatggagatatagatggatagatagacagatggaggcatatcattaactatctatctatctatctatctatctatctatctttaaacttgacatctgacatgttggatttttaatataaaatggaaaataattacagtgctgtagcacattctcctggaatcatgtgaaggtactgttataatatgcaatattgctataccactgtgatagtggtaaaacgcagatgaaatacaaatgcggcagaaactctcttaactgaccttctcttaaagtagttgtagattaagtgatgatctccgtttcaactgtaacacatagaaacttatgttcacagcacctcgaatattcttggacaataatactcctgcttacttctgatccctccacttaagtgctgtgttctaaaaagagttgtattttatccccaaactatttactttaattgtatgtctataatttgatcataaatattgtgatcctttatacacagttttaattacataatttgactaaaatgataaatataaattaaaaagaaatttcttgtttccttaaaatgttttggaaagatttaatgctaatgaatagctactaaaaattgttgctaaagtatgtatgggggagacaacttaaaagtttttaaagcaatcataaaaaatctggaagggttccatacttagattgcttcccaaatgtctttagtttcttaaagttcctcctctaaagacatccaaaaatggaaatcagagatgatgttatcttgattaagagcacaacttaagagccagacatcctgtgctttaattttatctctaccatttactaatcataagtttcaggcaagtttcttaccctcatatgtaaaatgaggataataatagttgctacctccaagagatagtgggaggattaataatagctagtgcatagtaagtgctcaattattaatattaatattattactgctaccatttatgtggttaattcaagaatgactacctggaacatttattggtggaaccatactcaaagaagaggcttgggctttatgtcaaaaaaaaaaacctgataaataaattcacatgttatctttacgttaaaataaatttttcagtcctcttctttggccaactttgccaattaacaaaccagttccaatcctaatcacttctgatgaagggttttcttatagattgatttaaatttctgtaaattattagcttaaaacacatatataagacacaaattttgtgaaaattcaaagctcctgtgacatataagcatcactccacccaatcttttcttctcatccttgtttttaagattaatagtctaaaacaatgaaacaatatgcctgcagcccataacaccccatcccactctgattcttctcttctgtctcaatgcaccactcatcttatacaagggtcaaagccctttcaagctgaaattgtcttctgctggcccaaaagaattccctttgtatctgctttcaaacatttcaatgttgttgaatctctgttattatcttaccttacagaaccatgctgaaatagacggttttagagctatcctgagacctagcttgctgtattgcccaggatcacccagagaggcctattgaacagaaacagaaaacaggaaagttacaaaagaaacaatttcttttttcttctttgggataataataactacttatggttagacaataaaggactgaagtgaaaagagtagtgggatcccaggttgcttctggtaaaatcatctcaatgttttagtaattaggaattgggctttactcaaatgttttatattggaagtttgtaattatttggggacaaactgttccctactttttggattggattagggcaaaataccccaaagcctacagctgattatcaaaagggaaggaagaaagtatcatccaaaagtatgtattaaggtcaggctttgttgggcttcttcccaaggattataggagacttggctccttctcccagcactaatagattaaggaaaattaattcagattgtgatgaaacttaagatacattagagctgaagacagaatggccaacaaacattcagactaagtagagagaaaagagaaaattactaaatattgccaattttatgtttctgttctgaaagctggatgtttgtttgactaaaggaattcaggattcaaatgtcttagattaagaatcacagcttttagcattaaaagtgaaaatcacggttcagaggtaatagcacaaagtgagatgtcagaagatttggattctagttccagctctaccatgtatcaaggtgaaatttatgaaatctcttactctctcagagatgagttcactgggaccaaacatttattgggctttaatctagaaccttagacgcagtgtttatcctttcctagttttggattcattatttgaaagctggggataataatagaaccaaactattataggtagaagtgatgattagaaggaataatgtatgtaaagagcatagcactgtgtctggcagctaaaaaaatatattagctgtaatttatctatccatttgttaaagatgaggtcagagagactggcaaaaaaggaacacatgtcagaattgatggcattaggtgattaaaggagagcaattgttaagtcattatttataattttttcagcctctgaagaaatgttggtactccagagcaagtcctcaagtgaccacaccctagtcaatcaatcaaatttctgatcacagatcttaacttttctatgtgaagatccagagtctgtgaataactttttcatagtacccattctgtctacttttaaattaaacaattaaccttgggaatacaagaatgtgcagaaacacaatttatatgtgtgattattattttagctttcattccaatattaactatactgtcttaatactggttactaccccacaacaattcagaactgtttagccaccaagaagatgatccaaattcaatgaggattagaagaggttttggggaatgctagagaaataacttctgtgaaaggtaaatgggggaagaagcaggattgggcagagaaagccttaagcctgagatgttgatttgatacctttgaaaggcaagtggggaggaagcaagtcaatgaaaacctcagacaaaggtgcaaatttgataaagtctcagccaacccaagagagagctcgggagcaaagactgatgttagagaagtgctgcactaggtagaaatggccaggcatcagtaccccatggtgctcagtcagttggtggaaattgcccaaaaagtatgcattggctttcaatgcatactttgaagatggttctactccttgtaactaaacagcagttttctttcttgacggaagatctgactggtgtaccagaatgagtgccaaagagagtttcccataatatatataccttcaatatattttattagaataagagttttttctgtttttcatacctgacataattttaaattgtataatttaaagcatttatatattttcttgtatatactttaccaaattcttgagttgctaattttacataacaaattacaaattatagtagaggattttaaaatatatatttaaagttgatttactttatttttaaggcaactaagtaaaatattctttcctgtattctcaaatataacaataaagttggcatttaaaatgctgagataactaaccataacatttcatccatatttttcattaaattaaaattcgtaattttgaaataatatttttgttattgcgagcacattttagatgcaaaaccaacatgctctattagttttccagttgtttgagaagagaagctatatctgtatattccaagtatattctaagaagttctatactgcaattgtaatgaacaaagaatcactgcacatttttggaatgtgataaaagagtatttaaaatatacccttcacatctgtgagtcatataaatcattcattgaaaatgaaatatgtttcatacctgccttcgcattttaccaaattcaggatgataggctatggctttatattactgtatgatataatgaatgctgtaatcaaaatgtgccatggacattagaaatgaaaagccatactctgattattcattgtaacagcaaaccagatatattctctcacaaatatttttacagagacatgtgcacagatagattgattatacagatatatactggaatttcaaattcactttaagacattttaagatatgtgaatattggttccctggataaactaaagatttaagaaatttaatcactagttaaatgatgatcatcgttattatgtaactaacttctgtattctgtagccaaaagaagttccctgtattctgatgagacttagtaaatatggctagcaaaaacagttcatttatttaacatttcctaagtacaccacattttgctcagtatttttccaacattttactataaaatttttcaaacatacagaaaagtgggaagaattgtatagtgaacactcaccacctgtattctacaaatagcatttaacttcacttgttttatcatattttttccatccatatattcatttatctgtctttacatcagttcaatttatttttaatgcatctgaaagtaggttgataaatcagtacatttctcttaaaatacctaagaattaactacagtttaatacagtctgccctgtgtatccatgggttctacatctatgaattcaaccaaccatggatcaaaaattcagtaattaccaggcatggaaaggccgaccttttcctatctgcaggctccacagggtcaacagaggaccatatgggcagatttcgatatctgcaggggtcctggaaacaatctttgctgatactgagagacaaaggaacaactatatttatttgtgtgtgtatggtggtgtggtggtggttttttttttccccaaggtcccaatgtgtcacccaggctggagtgcagtggtgctatctggctcactgtaacttctgcccccgccagggtcaagtgatcctcccacctaggtttcctgagtagctgggactacaggtgcatacctccatgcctggctaatttttgtattgtttgtggagacagggtttcaccatgctgcccaggctggtctcaaactcctggcctcaagcgatccacccaccttgtatttgtgtgtgtgtgtgtgtgtgtgtgtgtgtgtgtgcgtttttcatttgagataaaattttcacacaaaataatgcataatgccttgagtgtaccattcaatgaatttctacaaatgaacaaatctgtataaccaaaatgtagaatattgataataccccaggaagttatctcaagcctttgtactacttcccagccaatctcccaacactccacaggaaaatacaaatacccctctttttttccccctatagatgatttttgcttgctctagaaattcctattaatagaacaacacatattctttcatgtaaggctttattcactcaaccttttattttcagattcatccacattattacttatttcagcagttcattcctttttatttctgagtagtgtccctttgtgtaaagatatctgtttttttaatccattgttctctagattatggcctgatataaataaagctgctagaaccttcttgtactagtaattttttgtatgtatttttcttgagtaaatactgataaggggaattgatggattataaagtaagtatatgtgttgctttagaaaaaaattcagatctttcttcaaagtaattgtatgatgtttcactgccaccgacaacatataaatgttccaatgactccatatcttccccaatatttgctggtgttagtcttttcaagtttagccaaactggtgagtgtgctatgttagctaactgtgattttattttggatttcccttatgactgatgatgttggacacattttcatgtattcattggctgtatcttttcccttttgaattttctatcaatgtttttgttaatttttaatttatttatggttgagttccaaagattttgtgcatattttgataccagtattttatctgatacatgttttgcaaatttttctcccacactgaggcttgtttattaatttttgtaatggtgttttttgatgagtaaatgtattaaatgtttatgaagtttaatttttcattatttttcatttacaattattgctttctttgttctaagagacctttgtctatctccaaatcacaaagatagtctatgttttcatacaaaagatttatagttttactttttacatttaggtctattgttctgtctcaaattaatttttgtttattgcatgaggcaggaattgagtttcatttccttgcatatggatacccagttgttccagcactattcatggaaaagccttttctgtccccaatggattgccttggctattttgtcaaaaaatcaaatgaatatataagtggagagacatttctagtctctctattcaactctattgacatatttgttcgtttttatgctacactgtcttgattgccattatgttatagtagatcttaaaaagcaattattataaatcctttaagtttgttctttttcaaaattactttgcataatctaggttcttcctttgtatgtctatatgcctttattttcctatatgccttatatcgttggtctacttccttaaaagtctgcttggattataattgggaatgtgttgacactaaaactaatgttgggataaatgatatattaataatattaaagcttttcatccatgaacatgatatattttttcatttagttacgtcttgataaatttctctcagcagtgttttgtagcttataataaagaagtcttgcatagttttattaaatttacttctagccatattatagtttctgatgttattataaatcaaatttttcttacattgttctgaaattattttctaattctgtgctagtatataaaatgtgtttttttaagttatttaatttccaaatataggaaatttttctagatatgatactgctacacatttctaatttaatttcattgtagttagagcacatgctttttatttaaatccttttaaatttattaccctggttttatcatataatctgtcttactacatgaatgtttactaagaatttttgagaagatacaaaagaaatacaaaaattaaaccctgctttcctgcagttaactaaccacatgggagttaaaaatgtaaaagtgccgaacaatatgacattcaggaagggctaaaattacatcattagtatgaattgaatacataagtgattaaaagtctgaaaagaaaagatttatcaaagtaggggatcattcagggtatgcacccctccaatatttttagacatgagtcttgaaataggtgtttggcataaactattgaattggaagttggtgaaatgattagtagcacaagggattttaaaaagcattggcaattcatgagcagaagacagcgtggactcttcttcctccttccttttgttctttttttcacaaggtttttttccagcccagaatattttatgctttgtgattaatgctagagctacactgtctgtctctccactcaaagatctctcagtgaagaggaagatgtaggcataaatatattaaagcataagccttaggaagggggatgccagtacagagatagcaagcagagtatcaatagctgatttactttgccttaaatggcaccaggaagaatttacatagtggctgtctttgagctggatccgtaagaacgtgtctgctagagagagagaacgggaaagtcctaacagcacgaaagtataaggtaaatacagctagcagcttagggtgcatatgatgggtaggggaatgagtttgcaaaggtgcaaagcagccagataacaagatttgattgtgctgaaaaagtttgcattttatggtaaagtggacaggagtcatgaaatgtctttaagtagtacagtggcttgatcacatttgtgtttataaagctatctggcagaactgggaagggtggactggattcgggagaaactaaagacagggaaaccagctgggagaccatgtggtagctcaggtgattggtgatatatctgaagtgaggcaggaaagatgaattaatatgtgaaacatgtaagaggtagaatgaatagaaaactgaggacagagaaaaagtggtcatgagtgatttaccacttttaatgtgtttgacggggtgcatagtattttcattatgaagaaaatcaaatgcaagaaggaaggcagattttggaagagaaattgagtttcatttcttataccttgaggaggaataatccattagccaggtaactagagatctgaaaatcaggagagggattagtgtgagagatttgatttgcaagtcattaatattgacttgacatcagtcaagaagagaactggatttatacctaactggtatgtctaagggagacttggactattggatgaagattaggctgagataatttatgaggccttttctgggcctttgagtaactataaagtgaaaggaggagtggaataatatggggtaactgggagatggatgctggtgaagtagacagaagatctggaataccaattctaaaagtctggttcttaagcctgccttatttatttaacaaaaaacatatcagaaaaaaagtaattggaggaaagttaagctctcatcctacattaattagaatattttatggtttatgcaagagaaattaacttgagctagcttcagcaaaataagataccttcttatgaggattcagtggttcctcatagaagccaatgataagaatgccattgtaactatgaggcagacaaccattgaggatccaggctcagctgcactgtgtctacctctttctgtttctcccctcttccatccactccagatttgttttcctaagattctccttatgttatagttcctaaattgacacattatagcttcagacacccagtgttaccaattccctgctactattctaaatccccagggaagttctgtggcccagcatgggtgagatgctccatcctgatccagttaattctgtgtgtgtttagaggggccaagggactccaggtcaattaaataataatatctggggatgggatccagatatcagtattttttttacaagtgtttcagtttgaaaagcagtggcttaggctttgttacttttatgtaaagaaagactgtagtagggatattaatgccccccaaaagatatccacatgccagtacccaaaacctgtgaaaatatgttacatggcaaaagggaattaaagttacagatataattaaggctgctaatcatttgcccttcagatagggagactgttttggattatcttaatgtgcccaatataatcagaaaggtccttacatgtggaagaggtaggcagaagtgtcagtgtgtcagagtaatattattgttggctttgaaaatggaatacagccatgaatgaaggaatgtgggaggtctctagaatgtggaaaaggcaagaaaaaagattctcccaaaaagtttccataaaggaactcaactctgctgacgccttgattttagtccagtgtgactcttgtcagacttcctccaggaccataagataaatttgtgttgttttaaatcatgaagtttgtggtaatttttgtacagcagccacagaaaactaatacacagacactgttaaccagctttgttaatacttgaatacttggggaggcagggagagggagagaaagaggggtcaaaggtaattccaaggctgtattccttaaatacagtttcgatggtggacatctttttttttttgtctgtccattgcctgtctcttctgaaaacggcatctcccccttactgtttgttttcatttagaaatttttctctttatttttttttctttaaccatgtggttctaattgggtcccattcttatgtcacatacgcattttctcttcaggagtggttacggtactcaattctacccaatcagatgttttaactgttgctttaaaaactggaagtgagagaagagagatactttctctctggtaggaacttggtaggtgtgagcaacttgtaacaggctacggtgccaaaccagcagaacatgactttgagatgttctgttagaatgaccctgtctgtattgagagcctgagctggaattcaaagcattcctgttgctggttccatttaatcctatggccaatcatagacctaccctttcacaacttgggttacacaataacttcctgtttttgcctgatctacttcaatctagtttttgtcatttcaaccaaaatatcctgaaaaatttagacaaaaaagaaaaaaataatcaagtgaaaagttttaaaaaaacacatatgcacatttattaaggatgcaaatcttacttttattagcctagcaatttttttaagaacatgtatgtgaaatattttactagtgaaatgaataggacaaagtcctgcttccaggcacttacagacttactaatcctgcaaaatttgtgcctacattaccaatataccttttggcaatatatctctctacatcctccctaggcttatttgacaagtgcaagatagaaatgagttctagaaaatctgatttgtaaaatatatgaatggaagacaagaaaggttaaatggaagaattttgggatattcagatctttaagggcaatcaccaaactctcccataaaatgctcccatcacagttaaaatgcttgctaggaaagactattggtgtggtcctgtggcaattcttttattcttaataagccaaatgtttcttaattccatcacaattaaagtaaaaagaaggggaacttagtttggaataaatcacttcaggtccacagcccaattcactttggattcactcaggcgtgtgtttattttaatagctgatctgaaagcatgtgagatgccacagctgaccagactgtaaacagaaaagcatacaagttaaaaccaagcacgcatgcagcatggaataataatcaagctagactccttatgatgcaaaatgccagaaaacctccaagcattaggtcaaagtttacacaatagcaaaagccttttattctgtttcttagaggggcttgtagaagtttaagattcaagttctaagatagctctacctaaaaagcgaggtcaaagatgggttttcttctcaagatatttgggtaagtttgtacaagacggtttttttttttttttttttttttagaaaaagcagatagttgtcaccaagagttgtccggaaacagtggcaagggaattattcctcaaggaaagtgcaattctctgagctgtaacagtggacaatggtcgaatagtcaccaaccacgatctgggctcacacatagcaaagaggtatattaactaggatgccctacacaggcggtctgtggatgagaaatccctatgcccctcacttcaccagggctgaagagtacgcgatgaggagaaatgactaggaaaaggaataatgtgtggtgaggtatgtatgcgaaagagaaaaaggctggcggggacccgcggtggctaggagagacgtggcggcccaacggctgactacttgggcccgcgccgagccaggctttctccacggtgcgtgtgggagtgcacagaggggcctcgacggcttttctgtatgtgttataaataaaccccaatagtggaaagctccagcaggatgccctgagccctgggtcttcccagcagaagcggtggaggatccgcccctcgtttcccacccccgcgccccaccctgttcccgccccttctctcttaaccccgccccagcccagcccccgcctctttccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagagattttttttctgccatgtgttaatcatattatggttaggtggtaaatacgctgcatatgttcttattaattatgttctttttaataaggtaaaatggttatgtttcttttttcttacggatttagggaatataggtcagtaaaaacaacagaaatcatctgatcaaaacctcagagtgttctcagcataagaaagaactttctatactacttttgaatgactttggcatgatacaaaatggaaacaattgctctaaaggaatagactgagctccctgcatagtgtagtttgtcaagtcctgggaatagtgttgtctatagacgccaaggagcctgttgtttcctgcttagcagaacagcttgcatttgaaaagaaagcacaagatgaaaacattgtgaccaaagggcatcttcctatgtgtagagctcaaagactaaaagttggtttgtcacatcactaaccaagaacatgagttgatatggtaacaagaattaaaattatttactccatattcaaggatgaattttaaatataaattataagtctaattttataagcaaaagtcctcaaagagttgttcaaatagtctttaaaaggtacttttaaaaatctatagcaatttctaaaagttatataacttacacattgatgactacaatcataaaacccaaaacctagatcaagaaatttctagcactccagaaggcttcctcattccccttccttaaagataccatgattctaacatctgtcataatagatcactttttaaaagttcatatttggctgtggccatatggacttgcctttttatttatttatttatttatttttatttatttattttttttatgagacagagtctcgctctgtcacccaggctggagtgcagtggcacgatcttggctcactgcaagctccgcctcccgggttcatgccattctcctgcctcagcctcccaagtagctgggactacaggcgcccgccaccacacccggctaattttttgtatttttagtagagacagggtttcactgtgttagctaggatggtctcaatctcctgacctcgtgatccgcccacctcagcctcccaaagtgctgggattacaggcgtgagccactgtgcccgaccaagtttataggttttagaagcccatgctgtagcaggcaagtgataacaggctttaatccccttaaagcctgttgtgggatgggatactggcattgagtggggtaagggtgattaggttttaatgggagagtaatgggtgtgtgatcggttgccagggagggagtagaggtgtctcatacttgtgggttaaggtggggggatacgagaggaagacgtgaaggaggctttgggtttagaagaagggtggcaatgagatgtggctgtagtccaggaatagtcagggaagcagataatttggttaaaatgtctcggcctaataagggaactgggcaggtggggataactaaaaaagagtgcataaaagaacgttgtccaagttggcaccagagtaggggagttttaaggggttttgaagcttggccatcaatacccacaacagttatgggggcaagggaaacaggcccttgaaaagaaggtaatatggagtgggtagcccctgtattgattaaacaggggatggacttaccctccactgtgagagttactcgatggtgtccgtgatggtccagggggcttccaaggcgatcgggcagcgtcagtattcagctgctaagccaaggagatctgggaaggagtcagtcagacagccttgggccagagttccaggggctctgggagtggctgctgggtgagttggacagtccgatttccagtggggtcccgcacagatgggacatggcttagggggaatcctgggctgcgggcattccttggcccagtggccagatttctggcacttgaagcaagatcctgatggaggaggtcctgtaggaatgcttgaccgctgcggcttaggcatgtgaggcttaggcattttgaagttcttgtgcactggaggtgcggctgggttttgtctcacagcagaggcaagtaattgtaactcagaaatgcgttgctgtctggctgtctcctctctattattgtacaccttgaaggtgaggttgattaattcctgttgtggggtttgagggctggattctaatttttgaagcttttttctaatgtcaggagctgactgggtgataaaatgcatatttagaatgacacggccttctgacccttcagggtctagggctgtaaagcatcttagggttgctgccaaatgagccatgaactgggctgggtttttatatttgatgaaaaagagcctaaatgctcattgatttgggagaggtcggataaagaaaaaggaatattatccttgactatgcctttagctccagccacctctttaagaggaaattgttgggctgattggggagggctagtggcagaacgaaactgtaagccggactgggtgtgaggaggggaggtgatagaaggattatagggtgggggagcagaggctgaggaagaattggagcctgattcagcctggcagggagcgacctgaggaggagcagtctggggaggaggggagaggtcagatgggtcggtagaaaaggaagattgaaaagactcgtgatgcttggggttgggacctaggggacaggcgggagggaaagaaggaagatttgggatgagttgcattgggaacagagactagggaggggccgatgtgtaaaagaatgcctggatatcaagcaccttagaccatttgcccattttatgacaagaattatctagatcttgtaggatggagaaattgaaagtgctgttttctggccatttagagccattatcaagtttgtattggggccaagaggtgctgcagaagaaaataaggcatttaggttttaggtcaggtgtgagttgaagaggttttaagtttttgagaacacagactaagggagaagagggaggaatggagggtggaaggttgcccatagtgaaggaggcaagcccagagaaaagagagggtagagacacgcagagaaggggtagagggtgcttgccccccaggaaagtggtgcttgccactaaatgtgaaggatcaaggcaggtgtgcccatggtgattaggcacctctgaatcatgggtgaataatcaagcaggcatccccacagtggttaaacaccaagggaagactgtcttcctgagtccatgaccggtgccggagttttgagttcacagataaaacgcgtctcttctgtctctaccagaaaaggaaaggaattgaaattaacagaagggagagattgaagggtggtgccaagattgaaaggagaaagaggttgagggatagtgagagagggtggagaagagagtaaaaagaggctgcttacccgatttaaaattggtgagatgttccttgggctggttcgtctgaggacctgaggttgtaggtggatgtttctcacagagcaaagagcaggaggacagaggattgatctcccaagggaggtcccccgatccgagtcagggcaccaaatgtcacacgtgtccatgtgaagagaccaccaaacaggctttgtgtgagcaataaagctttttaatcacctgggtgcaggcgggctgagtctgaaagagagtcagcaaagggaaataggggtggggctgttttataggatttgggtgggtagtggaaaattacagtcaaaggggggttttctctggcgggcaggggagggggtcacaaggtgctcagtaggggagtttctgagccaggagaaggaatttcacaaggttaatcgctcagttaaggcaagaaccagccattttcacttcttttgtgattcttcacttgcttcaggccatctggatgtatacgtgcaggtcacaggggatatgttgtcttagcttgggctcagaggcgtgacagcagctttcaaaaccctttgtaatctggtcccgtgagtttatctaaccttatttctttctacagtccagataatagatatttataaaattcctattttgtgtgaaacactgagattagaaagtaatagtgtctatagcctttgtccctgggaatttttcaatcagaccgaaaatggtatccttctaatcttctaactagttgtctaaccttaagctcccagagattcttcttgcctaaagtcccatggtacttaacatctttattagtctatgctatgatttttttaagtttttagcaatgagacctaactgtgaaacaattttcatggaactctaatgtattacacagatgggaatgttgttgactacagaagtgtgaagcttgaatcccaccatctgtgacctttctcatcagccctgcttatttcaggtcagtccaagtcacctctccaaaccataaaattggatgaacataattgaaaagccactgtaatataacatctcctattggtatccaatttcatagctccttatcttaacacttcaaaaaagtcttcagaatctcctccactaatatactgcttggggttcaaaacgttctttttaatccagttgttcctaactcgcaaacatagcacactggctaccaacatacactgtaataattatgttaatataagaaagaaccatgaatgttaatggttctgattctttgtttatatcatttctatcatcaccgagtttaccccttgtcagcttgtcacccataaacatctccttaaaccatatttaatctctaaataaagacaataataaggtcataattccatctaacatccaactatactgggtacaacccaaaatacactaaccccttccccaaaagaggaggcaaagtccttgattgatgtttattcttctccctgatatcctataacttaaatactaagatataaaattagcaatacttaaatgctatgatacaaagtaatacatcttacatgataaggaaatgaggaaagaaaacaaaggtatttgcttaacacaaacacacacacacacaaatgtatttgttacaaactaaggaggaaatactcatgacaattggaatcctcattcctataactggtcacatggttatgcatgatatttataactaccttcttccactacccattctgttttccctatgccttcaacaagcacctctgctggttgccatacgttacctgataaggtaaaccaaatcttcattcctgaagtgtctgggccattaggagtcctgcttgaattgggctgttgtagtttttcatctcctgcattccagacatactcttccttacttccattgtggggtagtactccggtttgcccttggtagtcaggatcaatcacctcagccagcacagaaactcccttctttgcctgtagattagagaaatgaggagcacaaagtggccaggaagcactcttaacttccattcaatggtatcattgttgtgtctctagatggaagcatttttccctctggaactaagacctctaggctagcaggggttaaggtggtggaaacaggaaacaaaaatgttgctagcaggttgctgttggtgatagtgagtggtgccactcccatttccttgacttgattcttggagacatgaatcttggctatgggagaaacagcagcatatattggatgctgagtagaggccttctggaaaacctatcctcagctcttcaaggtattgccacctagctggcactgtaaggaagtcttcaaaaggccattctaccattgtatcagctgtttcaggatggtagagaacatggtaacatgagtgaatttcatgagcacgggcccattgccacacttcttttgttacaaagtgaagttctaaatcagaagcaatgccgtgtggaaaccatggcagtgtgtaaagcattctgtaagtccatggatggaagcaaatctgtatctaatgtaagtgctattccagtaagaacaaaaggctgttccttccttggtagaagtggtccaatgtaatcaacctggcaccaaggagctagctgatcaccttgggaaatggcttcaaaccaggggctcagtgtttgctgctgggagattgggctctcagtcatggctatagccaggtaagccttggtgagtggaactctacattgctgagccaatgtataacctgcatctctgccactatggccactttgttcatgagcccactgggcaatgacaggggcagctggggaaagaggctgagtggtatccatagaaaaggtcatcctatccacttgattattttgagtcctactctgctgaggtcaccctttggtgaacattcacatgggacacaaatatcttcacatttcttgcacattgagagaggcttattcatataacctcttttccaaattttcttctcactaattttccaatcatgttcctttcaatctctcatcattcaaccagtccattggccacagggaataaatcagtatataatcacatctggacatttctctttctaagcaaagtgaacaaataggtttgttgcttggagttctgcagactaaggatttcttttcatgagtgtctttcaggaatatcccagaaaagggctatagtcctgtagctgttcagtttggggtggtgcctggatattgtgcagaatcatctataaacttagcctagtcttcttttcctctgtcaactaagtgtgaggaattcaccatgaggccatgggtgcaggctgagagtgagaaggcagtgtagcaggagtgaggaacatgggcatttggtccacttcttcatgtaacttacttatgccttcagagtccattcagctcgatcacatatataccacttccaactgatgatgcagacagtcctgctgtgcacacccaactttatggtttggtgggtcagataacacccagtttgtgataggcagtttaggtcgcatggtcacttggtgacccatagtcaaatattcagtttccaataaggcccagtagcaggccaagggctatttttcaaaaggaaagtagatacctactctccttttaaaatagtgggtaaaagagcagagggtggcacgtgtgctccaaaatcccaagggtcttctctgtgtttcactcatagaggcctgccaaaggatccaaacagcatttttatctgacactgataccaagcaccattggatctgctggatcatatggcccaagagcagagtagtttgcagatcagcctgaacctatggcagagccttctccttttctgggccccactcaaaactagcagctttttaggtcactcagtacttgagttgaagtaacacacccaaatgaggaatatcatttgggtattcctccaaatccaaagaggcctacaaggcattatgcctcttttgttgttgttgttggggccagatgcaacaacttatcccttaccttagaaggaatatcttcatgtcccataccactggacccctagaaatttcactgaggtaaaaggacactgaattttagttggatttatttcccatccactggcacgcgaaattcttaccaataaccctagagtagttgctacttggtgctcactaggtcctcaatataatggacaagtgtgatatcttgtggaaggaaaaggcaatcaagagccctgagaatgaaattataacatagggttagagagttgatatacctctgatttaggacagtgaaggtatattgctggcctttccagctgaaagcaaactgcttctggtgggcatatgggcagtgaagaaagaaaagcaattttatctgaggaatgtgagccattttaaattatcaggtccagagaggcattaaattgagacagcagtcataccctccttcccccattgagctatgtattcatctcttgaaatataaccaagcccttattataaagatcataagatgtttgttttatttattgtcttttttctttgtcctcttccttatccatgcatgcttgcttgtatctagtcatttctatagagggtggacattagttattgataaacttgaaatcctgacccctggagctaccctcagaatcgatgaacttgtttttcttttaaagaacagtgatccataggtcatgcagacctccttgatgacatccacaagtttgattggaactgatgagatctagattccagggagtgcaaagagatttgatcattgggggatcccacctcctacattcttaccttactcataaaagtccccagttatttcaaaggcaggtcagatttgagactgtctcacctgccctctcactttggccaaattgaataaacctttctctgctcctaagcactgatatgtctgtgtttggcttaatgtgcatcaggcacgtgagcctaaatttcaggaatcgataacagattttgatgactgcagcaggacacatgtgctcatggccagtaggtcccagtcaggttgggcaaatgggcatccacacagctgcctgggtgtgttgcttggggtaagccctggggtcacccttctcagtaggtgtcagctgcccttggcaccctaggagcttggagcagagaaacaccttggactgcttcctcaattttcagttttgatttgaagggcaagttgttacacatgcgcaaccaaatctctcattctctccatttgtattttgaagagagcccatttgggagagtaagtagaatggtagcctatactgatttgcttgtttgtgtacctgcagtagtttggttttgtgtgtgtgtggaaggattgaatgtgggaaattcaggatcaatctcagagtgcagccttctttggctgtgttttccagaattgggccactttcagctaggagtccatgaggaaaaagaaaatgttttcattattattattacactgcttggcctcaatatgccttagattctggggtaaagtggcttgtgaatgggtctttaaattatgttactataatgcaactagaactgttttgtaagagggagagaaaatgggatgagatcccatatgttcggatttttatgcttttgtgtcagaataaacctgctcaaaaaaggtgtagtataacttgatgccgcaaaaggaagaatagcccaaacctaaggttttagactttccaccattagatgtagaggacaaggtgctgatcagcaccttgaatcccccaaataatcatcctggtcctctgccccttcctctgccacctgtggctccagcacatccccctccttatggaacatgtggagcaggaggaggacacccccaatccctcatgggggaaaaatcaggataggttatgaattcttcttcttgtacctgacaggtaacaaaatttggccagtgagccacaggcccctaggtagggcagtttcctctctgctaatcccctgttaggataatgtgaatgagcatttggctgatatgatgtgggtgcactccacttttcccacttcagatctgttcaattggaaaagcaataatccctccaatcaagatgaccccaagtaaatagctgagcaattctcatccatacttctgacctattatcccacatgggcagatatccaggctttgttaaatgtactgctcacagcaaataaaaggaacattgtcatagaaaaaaactaaagaggaagcaacctggctccatcttgaggatggaaataatctccctgagccaatgcagtcagtccgcaccacggaacccagttaggatgtaaataatggaggtcttccccacttagagcactattaaagttgtatccttgaaggtttaaagaaaggggtccctccaagagccttaataaagtacaggaggtacagcagcaaccaaatgaggccttcacaattcttggaaagactatcagacatatcaaaagtttgcaggtggaactggaaaatcagagaatggttaatatgagcttcatctgtcagagtgtccctgatagtcaaagaaaattgccaaagatagatgaagccattgtgttgccaaacacatttagtctagttagcttttagggtgtactatgcttgggttaaggatcaggaaaagcacaagttaaagcaacaagtatccatgttggtgatggtgcttgactttcaacctaaaagaaatgaaaaaaatcaaagcaaaaggaggatccaccccaccttagggaagaaccagtccacttattgtaaggaagaaggacatcggaaaaagggccatcccaaactgaccaaagtggctgtcaagcccaactctccctcagaatcagatgatgggaaggggaaaagactgagatgaaagttgatacagcccaaggtgtccctgagactttgaatgaccagtacctgtatccccacaggaacccaagatacaattgacattggggaacagaatgattgatttcttaaatgataagttgccacatgatcagtaattaacatttgtctcttcccaattatgggagaaaccaagattgttatggggatattggaaggtgccattatttgcccctttctacaacccttagattgccatttaggagagaccagcctgaaacagtttcctgtatgtgcctggattcccagtgcccctcctgggccaggatttgcttgccaaattgtgtgctcaatttgtcttttcctccagacacctagacatagggattcctcctgaacaagcttgcaggtttcaaaagctccaactccaaccagaaaatacagaagtttaggacattccagagaaaattctcatgaggttagaggccctcttagcgcagtgggcagcgcgtcagtctcataatctgaaaattctcatgaggctaagggaagatatttgggcttcagggaagctggggagaatggtcacagccaagcttgtaaaaaataaatgagggacacagaatacctaatctaaaacaacacccattaaaggaggcagtatgaaagggcattcagctgctcttggaagcctttttgggacaaggactaattcagccctgtcacttcccctacaacactcctgtcttgctggttcacaagccctgttcagctgactactggcttgtgcaagacttcagggttattcatgaagtagtccaggacatacaccctatggtacctaatccctatactttgctgacaagcttatcaggagataagacaaggtaaatcattacatggtttataattttggatctgaaagatgccttcttttgcatactgctagatacggagtcacaagaggtctttgcatttgaatgggcaagaccaggaatgcaggtgaattagcagtactgttggagagtgttatctcagggatttttaaaatttacccgcaacctttgggagaattttggcatgggacttaagggatttctgaccgaaagaagaatgcttttacaagatgatacctttgtttctagtaagactcttagagattcccttgaaaataccatccaaatactgagttttctaacaaaaagaggctatcagatttccaaaagaaaaagcccaaatctcccaagccctgatctccaaatacttggagtttgaaccaactaagggacaaagaaatcttctcccagactgctgagaggcaatagcctgggcagccgtccctaccgcctgcaaacaactgtgaggttttgtaagtatagtaggattttgttgaatttagattccaaattttgaacttacagtaaaacctctttatgaggtcctaaagggaaaggaatctgaacccttggtcaggacctcagaatgccaacattcttttaataaagccaaagaaaagttaatgactgctcctgcactgggtcttccaaatgtcagaaaatttgttgatgtatttgtgcatgaaaaacaaggcatgagcttgggagtcctaactcaaagtttgggaccttactggagatcaattgtttatttcactaaatagcttgatcaggtggtgaagggttggcttccctgcctccaagcagtagttgcaacttgttacctcctctaggaggctgaaaagttaactctcagacagccatcaccattcacacactgcatcacatcctccctctcttacagcaaaaaggaggggtattagctgactccagagaggttagggaaatccaggctatgttcttttacaaaccagagttaaaaataaaggcggtctcagttcttaacactgctaccttaaagcctacagaaacggagccagggctacacctaattttcttcagaatattcagcagatcttttccagctgaccaaacgtggtgtattagcccttggcacatcctgacctgaaactgttcacagatgaaagcagcttcaaggaccatggaagtcatcatgcagggtatgtgtggtcggtaccttacaaggcactgtgaaagccaaagccttattgccagacacctcagtacctcagctcaacagcgtgagctcattgccttactcttgtcatccaattggataagaacaaaattgggaatatttatatagactctaaatatgctttctctgtggcacatgcccatggggctatttagaatgagagagggcctttgactagtgataacaaggaaatcaaatatgtctctgatattttggccttataagaatctgtaaatgcccccagagtggtggctatcatccactatcctagccatcaaaaaggggaaatcaacatgccaacctggcagcgaaacaggctgcaaaaacattggactttgaggccttcttagccctgtttgtatcgcaggttgatcttactaagtaagtctcaaccttgctatactgaagaagacttaaagtggcccaaggattggggatttacgtccccagccccaggccatccaggctagatatgtaatttgggaggcattatattggttcctggagccctccttaaagatacagtgagttggctggcgcagtggctcatgcctgtaatcccagcactttgggaggccgacacaggtggatcacttaaggccaggagttcgagaccagcctggccaacatggtgaaacgctgtctcttcaaaaaatacaaaaacactagccaggcatgggatcacttgaacctggaaggcagaggttgcagtgagccgagattgcaccaccgcactccatcctgggtgacaggacaggactctgccaaaaaaaaaaaaaaaaaaaaagtagtgagcaagtttcatcaaagcacccattacagaaaagatgcaaccctttaatggctacgttagtacttgattagtcccaatatgcaatgggtaatccaaaatatgatccatcagtgcactctctgtgctcaaaaccatcctaaaattggacccgtaccccctgttcaggggactcttgaggagattctccatatgaggattggcaagttgatttcacaacaatgctgtgagtgcccaaaggctatagatatcctttttttttttttttgtatacacatttacgggatggatggaggcgtaccctacccgaaatggcccacagcttacttaaagagataatcccctggtatggactccctttgatattcagagtgacaacaacacaacatttgtctctcaggtagtacaggaaatgtctcagatcctagacactgaatagaaactttacacagcatggtgtccacaatccacaggaaagactgaaaaaaatgaatcatactataaaaagaacaattgctaagatgtgccaagaaaccagtctaacttgggtcaaggtactgccctctgccctgctgagaattcaggttgctccctaaagtaggctccaattgagtgcttttgaaattaaattgccaaattaaaaagtaacctctgttcaagagtttgcttctgacaggttggccttccccatggacatgccacttcaccctttccaggccagagaccaagtcctactcaagacctggagggaaactggactggatcatcaactggtccctcaatgggtaggaccctatgaagtcctcctgaccactcatttatctatcaaattggctgtggttaaactttgggtacattatacccacaggtaaagattgcccctcctcagctcaatgtgtgaggtaatcaacctaaatggacctgtgaaccaactgaaaacttgaagctgctctttaaggaaaactttgcaaataagtaaggccttctatcatttaattatgatattcttgctaatccccataataatatatgggcttatggtgtctcctgaaacgaatcttttcctacaatgggcacagcattatacagatagcctacaacaggaagcttgtggggtttgtgggctgctacctatatctagcatttctggattaccttggtgggtctcacctctacaaggaaatgactgagtacatttacaaaccttaatgaaaaacaatttacaagaaaatcaggtccctggtgttctaacacaagaaaataaaaggttatggcctgtcattaatgtaaccctccaaaacccaggtcacagaaaaccttttactatgaatcagactattcgacaaacttctgaatatgctgctcctctcctgaatgagttcttggcaacccccaaagttttgactattaacagtcactatactgaggaaggtttctatttagtttgggatgatttcctttggatgacacccaccaccagctacttaaatcaagttgacaccttaggaacaaaaaaaataactcttatgatcattgcccaaatattaatatgggctggatgcccccacaacaatgtcaacatactctagtgctgcaacaaactgactggttttctactgattggacacagaggctaggaattcgatgactagccccaaatggaactaaatggctatgtgacactgatctttggccctgactaccttattgaatggatagaatggtgcaccctgggtttcccttgggtccagtttcatttggaaaacacagatggacagcctgcagatctccaatatgtgttgtaccaatggaccaggttggtttccactgttatgaccatctcctatccatttctgttccctaagttagtttagaaaatgttatctggcataccaggaccctctcaaactatatgcagcatatgctaaagaatgcattcagaggcatctctttagtgacctctgaaatgaccatgatgagaaaggcaatcttgcagaactgcatgaccctcaatgtcctcacagctacacaaagggaaacctatgccataatcaaaaacaaatgtcttgtatacatcccagacaatacaggaaactttaaagatattcacaaattaataccatgtctgaccccatgatgttgctaaaccaatggttatcttcttggtgcaactctatactctcttgatggaaaaaattaataattctagctttgattataggaataggcatactcctttgttgtggattatattgctgctgcactatatgtataagatttcaaaatcacctctctcagaggatcctaacaccttgttcaatgatactgcaaagaattgcttctgtaagtcccagaacacatgaatgttttcacctgcaggtaaataagggccattccctggacccctagcaatggcccttaccagcaggaaatagttacaatgaatcaacataccaactcctcaagattgagaaatggaacaatgacattgaggatgttgtaaccgagcccttattttaagtatcaggttgttttacttagtctcctttgtctttgtccttttcctcatccgtgcatgcttgctggtacgtaatcatttctgtagagagtaatcactagtaattgattaacttcatatcctgaaccccggacctgctctcaagattgatgaacctgtttctatttcaaagaacaatgatccttaagtcatgcagatcttgatggcatccaaaagtttgatcgggactgatgacatctagagtccgaggggcacaaacaactttgatgatcccacctcccgcattcctaccttattcatgaaatcctccaattatgttcaaaggcagatcagatttgagagactgtctgtcctgatctcttgctttggctaaatcgaataaaccttcctctgctcctaagcactgatgggtcagggtttggcttactgtgcattgaatacgtgaaccaaaattttgggatttgatgacagaaactgcttgctattgccacaagtagctacaaattaacaatactgcacaagacaagataacccaagccttatagattaacaatatatagccaatcactaaccaatattatttctataaaccaaagagaattcctgacaaacaactttgtatcagcccactctctgtcccccttttttgcctttaaaaatctgcttgtacacaggcaaccaaagcaaaaatgtacaaatgggatcacatcaagttaaaaagcttttgcacagcaaaggaaacaatcaacaaagtgaaaagacaacctacaaaatgggagaaaacatttgcaaactacccatctgacaagggattaataaccagaacatacaaggaactcaacccacattataggaaaaaaatctaataaatcaaaaaatcacaaatgatttgaatagtcatttctcaaaagaagacatacaaatggcaaacagggatatgaaaaaatgctcagcatcactgatcatcagagaaatgcatatcaaaacaacaagatatcatctcaccccaattaaaatggcctatatccaaagacaggcaataacaaatgctggtgaggatgtggagaaaagggaactctcctacactgttggtgagaatgtaaattatcacaaccactatggagaacagtttggcagtttctcaaaaaactaaaaatagagctaccatgtaatccagcaattctagtgctgggtatatactcaaaaggaaaaaaacaaaaacaaaaaccaggatatcaaagagatatctgcactcccatgtttgttgcagcactgttcacaatagctaagatttggaagcaacataagtgtccatcaacagatgaatggataaagtaaatgtgatctatatgacacaggagggaaaaagaaactatttaggcagataatgagggcaaagagtcctcagcagaacttcccttctaacaaaaagcagcccaagaaatcacttcttttctaacaaagagcagcctggaagatcgggctgcaaacaaggataaggaggctggaagcttgcactgaggggtatgccagcagctgcacggatagaaggggctacctgggaccaggcatgttcaccatgggagtttcactgccccttttttagcacatgcacagtaagaaacaagcaacatggagtagctcaggctgaggactcacctgcataataaaaggttggggtgagggctgccagagattcccaccatatgcagatggcacacatggtcctaaccggtttttcgtgccctatgtagatcagataccgcctccccactagctcatctataaaaacccctgcatttcactgtgggacggcaaccctttttccaggacccttctctgtaccaaacaactgttctctttctcctattacatttctgctctaaacctcatatttggtatgtccacgtccttgatttccttggccatgagatcaagaactctgggtgtcaccctagacaatgaagatcattatgttaagtgaaataagccaggcacagaagcacaaacatcgcatattctcacttacttgtgggatccaaaaatcaaaacaattgaattcatggacgtagagagtagaaggatggttaccagagtctgggaagggtactggggtctggaggggaggtggggatggttaatgtgtacaaaaatagttagaaagaatgaataagacactatttgatttcacaacaatgcgactatagtcaataataattgtatattataaaataactaaaagagtataattggattgcttgtaactcaaaagataaatgcttcagaggatggataccctattctccatgatgtgattattacacattgcatgcatgcatcaaaacatctcatgtactacacaaatatatacacatactatgtactcacaaaaattaaaaaaataaataaaaatttgcttataacaaaggccagacagagctcatatccaagtgtacctgtgtctcaatcttcctcacagctgtcttcattttggctcaagtgaacgctttaaattatttattgtgcctcagcctcttattttaggtcaacatcaaggatggagataaaagacatctgccagatgcataccaggccagatgcatacctgggaccagatgatgttttaatttgctgatgcaatgaaccaacagctggtaaagcagctgcaattggattttaaaaccatcacctgcttaatcttttgataatcttgtcattctccaagattcctctgtgttctatacaggtcaaatagaaaagttgaatggggatgtggtgggaattaccaccacctttgcctctttcaagtccttgatggtggcactaatctctgcagtcccttcaggaatgcagtattgctttggatttactattttccttggtagaggatttctaggggcttctacctgacctttccaaccctaacagttctcacttcacaggtcagagagccaatgttgggattacgcagactgccaagtatgtcaattccaattatgcattctggaaatgggaaaacaaccacaggatggttttggagacccactagccccattgtgggatggacctgagctaaaactccattgatcacctgggctccataagctgccactttgactggtcagccacagtgatgttttgggtctcctgaaactagtgccagttcagagccagtgtatagtagtccctgaaagatctgattatttccttttccccagtgcacagttagcctggtaaaaggtcatagattcacttgaggaaggctgggagaaaaactaaaagtataaatttttggtagtgaactggggtccttcctcaaggaaacctaacctcttcattcaagggattctgggtctgtaaactggcttcagtctggaaattgattgaggaatctgagtctctgcttttatgattcatgttaagcttttgttcatttaagctagaacttttctatttatacagatcaaataagaatttagtaggcttcctacctatttcacttcaaggagcaccatgatcaattagccaacactacagttctgtgcaaatcagactattgtgattgtggctttgactctgttgtccattatggttaacaatgtgcaccttgcctttggtaatggagtactgccacttggcccctgccaccctgtgatccaattattcctattgcatttaagtttccaactcagtgattgcagttccctctgtaatgtatggcctaaagagaagagaaatcatggagctcttgaagtatgctggggttctcctcataaaaatttttcacagaattggtataaaggaaacaaaaaaaaaatttcacccccagaatatactgtgacatattatttcaagacggttattcagaaggcctgcagacaggaatacttctgaaaagctgccttttgtggaggagatttgcatctgtagagaaaaatctacattaattaaataaacagccaggctttctctgaggcccttccccttgtatagatagggaagattaattcaaccacaggttgccatctgttgtttctgaggggtgctacctgtgaggattcatttgcgtaacaaaactgactttacctcttgcccttcttattgtctcccttccataacccgtcttgccaagttccaagtccctattctttctgtaacctcaggataatataaaaccttcaaccaactgatctctgttttgagcttcatactttgtatgtgactcccatgcccatatgcatatgaataaacttgtatgccctttttacctgttgttaatctattatcagttagttttatagactcatttttgtcaaacctacaggggaaaaatttactcttccccacaggtgaaaagtatgtcttctggaccttcccagtgtgggtgaatgacaaatccactataatactccagtttccctaagactttaaatctggtcctttacattaaacaaaggcaagacaggcatttcaactttgctctgggccatattttgattcatatttcagttaaccaactagccaaactattagagtcctttctaattccatgagctgcaacattaaatgcagaatctctgctttgtgagcccatatcaataaatttaacctgatcaaactttgtggtccttccactattatcctacacccttagtatctattcctacagctgctcgccagattctgtctctatcagttagaaaacggaagtagttatttgaattgtatcacacctcctcacgggtaactcacctttggggtgtgtatctagttataggtctagaaacaaagataaacgatgaaggtggagcctaaggtgaatcagcattgtctacatgacaactgccttgagggaggccattatagtttcctcaggcaatgcagggttaatctcagattgagataggaggtccaatactactgaaggtggacaagctaatgctactgtcagtgaggatgtcattgacactgggggtgggtatgccacttctgctgaggttgggaagactgctttcactgggtgtggggagatgtcttccactggcaaatatgactcatcagaatctagtggcttgagcccaggaggtggagtttgcagtgagccaagatcgcgccactgcactccagcctggcgacagagtgagactccgtctcaaaaaaaaaaaaaaagaatcactcctttatataggatttgttttctttggtcagcaatatgaaactcttaagaatcagtattcctaggatatatttatggctggatcagtttcacaagacaccttcatatttacaaagggaagctacaagttctttttgtctttccttaacacatcaagcataaaagcaacttgaaaaagtactttatgttaggtatgagttctaaatttcttttcaaagaatcaatatgtcagtatgttcaattctttaccttctagttttaacttaacttccttataaagcaacctttttcaattacctgctccaccctgactaatttcaatcacctgttccaccctgactcattccgattcctactcctgctctgtcataaccatttttccccccaaaccactcacccgtcactctctttaaattagccaattggaattagtttagcctgtgcggtctaatcctagccaataggggaatgacacagcagcaggggccacgtgcgtcagggataagaacccttcccctcctttgtccaagtgtgtgctcaccattgctccatctgtaagggtgcacccttctatagaagtaacttcccttgctgagaattaaaagaaaattttatattcgagtgctatttcttttgtggcaccaaactttatatataacaatttgggggctcccctgtgattacgttcccctccggggacagtctctggttctctctcgtgaggaggcgcggcctgccgccttgtggtggcctcaggggtgagaaatcaagacccacccagtgcgaggaataacccaagctctcagcaacgcggggggaaaaaaaactggccagcaacctagcttaaaggatcctcacatactgcggcaatgactctgtgcacagaccaaggaaggagaagccacgggagcgggtaaagtattccgttggtggtcggaaccaaggtaagaaagtgaggggggagcggaggaggtgaagtactccttggctggggtggcttagagtttaaaaagaggcgagacatccccactggtggggattgaacctcacacgaacctccaggagtagaaaaggcaagaaatttccagtgggggaaatgagcctcaccccaaaaagtgagaaattatcagtaagggaaattgaaccttgaaccttaccccaaaaccatcaagatagactgagggagcgaatgaggcaatatgaaagcctcaatttggatgatccccttgggcaaggaaggttgaaactccaatttgtcactaaaagttggccagacatttcaaaaaagttacaaaagatagacaattgggaagaccgtcccctaagtgagcttctcagggaagctcagaaagtatacgtgagtatacatgaaaagggacgaagaaaaacagaaacaaaagacaaaacttatgttttccacctttcaacagatggctccaaacccaggtacttctagacagtttccagggagctagaaactataaagggtccgaaccctcttttaaaggatcccagcctccatctggaggaccaaggtcctcgtctaccaggccccctaaagagtatgggggagcagggttaaagaatcccagaactaaggaggaaggacaagataggtgctgtagatgtggaagaacaggccacttcaagagaggatgtcctgaactaagaaaggagaaagaagcccttccacccataactttcgaggaagaataggggggtcaggggctctgtctcttgagtcccaccaggagcccttgataaatttggaggtgggacctaaacatgagcttatcacctttttagtcgattcagaggctgctcgctcctctgtttgtttccccccgtctaatgttgtctcctcctcagaggaacttttattctccggggtaaaaggggaaggagaggggagaacagcagcataagtggctggcagaggcagggaaagaccagcagagaggagagagacagaggagggaaagagagagagaggaaaaagagagagagagaggaaaaacagagagaggaagagacaaagagggagttagagagagagagagagagagagatagaagtagtaaagagaaaacaatgtaccatattcctttaaagcccagggtaaatttaaaacctataattgataattgaaggtcttctctgtgacactctaacactccaataccaccttgttgtaagtgtaaacaagggcatagcccgaaagcactgaggccactgacaacccgtagccttcctatcaaaaatccttaacccagtaacccatggatggcccaagtgaattcaatctgtagcggcaactgctttggtagcagaagaaagtagaaaaataacttttagaagaaacctcattgtgagcacacctcgccagttcagaactagcctaaggggaaaaaaaaaaaaaagcaaaaaggtagcttactaactcaaaaatcttaaagtatggggctattctgttagaaaaagatgatttaaaattaaccaccgataattcccttaactcagcaggtttcctaacaggggatctaaatcttaattaattaccatacaaaggtccgaccagacctatgaggaactcccttcaggacaggagatagatggttcctcccgagtaattgagggaaaaagacacaataggtattcagtaattaatagggaaactcttgtaaaagcagagttaggaaaattgcctaataattggtctgctcaaacatgggagctgtttgcactcagccaagccttaaagtacttacagaaccaggaaggaaccatctataccaattgtaagttaatttggactaaacaaggtcttattaatagcaaaggataattgaaatcccaaacttataaggttttcaacaaaaagtaaagtttgctaaaagttaacagtgtaacatgtattatcctaacttctaatcttgtggtcttaggcagtctagtccacagacatgaaggaagttcgctgtggaaaagaatggttatcatctttggaaaaaaaaaggaagagaatttatgtaaaaagagtgttatatggtaaattcttgtcctaaaataaatctactggttgtttaaagaaacagatgtttgcaacaagtgagaaagttgagacatgtcaaagaattatctgtgaaagtcgtgaaaaaaaaagttataaaagggaatttatgcaagaaatgttgtataatttaaaagtaattaggcctcctgaatgtaaaactattgaagaaagtttatgtgcaagatgtataaggaaagtaaaatatacctttggtaaaaggattataaggaggcataagaatgtggatttttacctacattaaaaggttaaatatatatatatagttttaaaggtttaagcaagttttgaaacattaattgtaaaggaaattctgtgtgtaaacatactggctaaagttaaagaggtatcatccagtttttctgtgaactggacattaaaataaaagcacaacaggtttttcttaaagcactaacctgctctttaacaaaaattataaaaggttgaaaagagtctataaaaatcttaccttatggtcacatgttaaaattggataaatatgtctacaaggttttattaaaattgagtttaacattaataacacactaaaggtgaaatttagcttatctggtataaagatcatacaggaagcattgtcaaatataaaatggtgtttggctttctttggtataaaaactaataaaaattggtgctaaaggaaatttctcagtaagaaagcaccaaggactataaagtccactgttgatgtccccacatttaaaacaaaagatcaatttcttagaaattatatacttggattatcttccactttcctttccctcaaaactaaaagtcttttagcacaggtaccacccctagaatttccagtaaaccagcaccagcctgaggatcacgttctcatcaaagggtggaaagaaggaaaactccagccagcctgggaaggaccctgccttgtgctgctaactaccgagactgctgttcgtacagtggaaaggggatggactcatcacacccgagtcaacaaagtgccgccccctcctgagttgtgggccatggtcccagggaaaaaccctaccaaactaaagctaagaaaaatttaactctctttcatctattctattactctttcttctttcctcgctctattgctgaccatctagttattaacataaccaagtcaatttcacctcaaactattgcatttaatgcttgccttgttataccctgtggggacttgctaagtcaaagctctctacttcagaaaagtacctctgtccctcctgactctcctcagactgggcattagtgaattggcaccatttaatccgggggagattttgataaagaccccagtgtcaaccaggagtcttgctccctgttgtagagcttttatgccgtagttagtccaacattctgtagaccactaaagaccaagagtggactgctccaaacggtttttgtaatttcctaaaaccatacattcattttactagaaggacggccctcccccctaactgtcagctaaaccaatgtaattctatatgggttattatctcaaactctcaaagttctctcccttttctaagccagttcccttctttaagcctggaattggcttttatggtataggggctgaggtttcagggacaaaccctattagattctttaaaatgcatttctttgatcccccaacgcctgcaccttcctctaagccttcttccaaaacctctcacaacggaataattgctcctcctccatctaacgacaagaccaagatagctatcgtaaaagttaaagacttaaaacaaactttggcaattaagacaggataccagttggaatggatcaaatattccatccacacgttaaacaaaagcaattgttatgcttgtgcacacagcaggccagaggcccagattgtcccctttccactaaggtggtcctccagtcgaccaggcatgggctgcatggtagctcttttccaggattctacagcctggaatagtaagtcatgccaagctctctctgctatatcccgaagtctggcaccctgtgggtcagcccccgagggccatccagcttcagtctcccaacactaagttcacttcgtgtctctcacgacagggaggagacttagcattccttgtagacctgaagggatgcagtgagcttaagaattttcaagagcttatcaatcagtcagcccttgttcatccccgagcggatgtgtggtggtattgtggtgaacctttactggacactgctgaataactggagtggcacttgtgctttagcccagttggctatccctttcaccctggcatttcatcaaccagaggaaggaaaaataacacatcgtaaagcgagagaagccccttatgggcctttagactctcacgtctatttagacacaattggagtcccatagggaataccagatcaatttaaaacccgaaatcaaatagctgcaggatttaagtcaatattttggtaggtgacaattaataaaaatgtagattggataaactacatctactacaaccaacagcgatttattaactacattagagatgctgttaaaggaatagctgaacaattaggggcaactagccagatggctggggaaaacaggacagccttagacatgatattagcagaaagaggaggagtttgcgtcatgatgaaaactcaatgttgtaccttcatcccaaacaccaccaccactgatggaagtataacaaaggcattgcaaagtctgactactctgtccaatgagttagccaacaactcaggggtaaatgacccctttacaggatggcaagaaaagtagttcggtaaatggaaaggaataatagcctcaattcttacttccctcgcagccgtaatgggtgtacttattcttgtcaggtgctgtgtcataccatgcatccgtaggttgatgcagaggctcataaaaacggcacatactaaaacctcccttaactatcctccaccttatccagagaagcttcttttggaaaatcaagcaaaacagctaagccaagacatgttaaaaaaaggtttgaaaagaaagctgtaaggaaatacaaggggagggattgttagatatgagttctaaatttattttcaaagaatcaatatgtcagtatgttcaattctttaccttctacttttaaacttaacttcctcataaagcaacctttttcaattacctgctccaccctgattcatttcaatcacctgctccaccctgactcattctgattacctgctccaccctgactcattccgattacctactccaccctgactcattccgatgacctgctctgtcataaccatttttcctgccaaaccactcaccctgtcactgtctttaaattagccaatcagaattagtttagcctgtgcggtctaaccctagccaataggggaatgacacagcagcaggggccgtatgcatcagggataagaaccccttcccctcccttgtccaagtgtgcactcaccattgctccatgtgtaagcatgcacccttctatagaagtaacttgccttgctgagaattaaaagaaaatgttatattcgagtgctatttcttttgcggcaccaaaactttatatataacatttagtagctctatgttggcttatatgtaactctgcagttgtatttttcccatcaaaataggggaaaacataattcttgatcctttgctgactgcagtgctttgctttttagagcagtgtctcacataactgctaattgacataaaacattatctcagcaacaatcactcacacagaataaaatacacacattttttctaacaacaaaattttcatctttgaaagtgattgttttgactttataatcacaaatccataatttgaaaacaaaattaatgggagtgtggtaatttttaatataaaaaggagttctcatttggagaaatatatcaagaaatatttatgaatgaaatgatacaatgtccttgattttcttcaaaatagtatatcaggtagaaggtgagaaagtttgccatgaggtaataatttttaaagctgtgagatgagaacatgggaatttatgttttgaaattttccctaattaagaaacaattcatgcccccaaaatgtaatcaaggtagaatacagaagatcattttacacaaacatagtttaaacacataagtattgaaaaaataacatagctttagttgttttacatttattgttgaatttagtatgaggttttaaattcaataaatcttttttgtgctagtaatcaaaagaaattgagaatcaattttagtttattcttcctcatactaatagcttacataagaagtcagttttttgccaccctgaaggaaaggaccttgagcaaggcacagtgctgtgctggcttgaggtctgacccggcacactgccagtagtggtggctacatgggtgcttacatcaccacacccccagttcaaggtggctcagcacagagagggagaccccatatatttaggagaaagtaagggaaaagaccaagtgtctctgtcggtaatccagagaattcttctggatcttatccaaaaccaccaaggcagcacctctactactctacaaaaaccacagcgttattgggcttgggacacaagtcccaatcctattgctgggtatatacccaaagaaaggaaataagtatgtcgaacagatattgtactcccatgtttgctgcagcattgttcacaatagctaagatttggaagcaacctacatatccattaacagataaatgaataaagaaaatgtggtacatttacacaatgtggtactattctgccataaaaaaagaataagattctgtcatttgcaacaacatagatggaactggagctcattatgttaagcaaagtaagtcgagcacataaagacaaacttttcatattcttattattttgtggcatctagaaatcaaaacagttgaactcatggacatagagaatagaaagatggttaccataggctggaaatggtagtggaggccaggggtgggaggtaggaatggttaatgagtacataaaaatagaaagaatgattaaagcctagtatttgatagcacaacagggtgactatagtcaataataatttaaatttacatttaaaaataactgagagtataattggattgtttctaacacaaataataaatgcttgaggaaatagatacccaattttccatgatgtttttatgcattgcatgtctgtaccaaaatatcctatgtaccccatatacacctactatatacccatgaaaattaaaaataagaagtaaaatgagcttctctcacttatactatattttaagtagattacagaagcttccctggtaactttttccagtatttaaataacaccattgttggatgacataagcttaagaaaatattcatcactcctggtgagacaatacataaatacaaaaatacataaatattttattgcacagaaaaagggcaaacatagagatttgaagaaaatctaggagaatgtgtacacttgatttatgtgaagaaaacttggttattctattcttagaaatgttaactggcaatgcaaaaatgattaaaatttaatttccaaggttaactttattcataacactgcttttggcaatgaagatctcatgagaactccctcacggtcatgagaacagcactggagaaactgcccccatgagccaatcactcccaccaggtccctccctcagcatgtgaggattacagtttgagatgagaaatttgggtggggacacagagccaaaccatatcactgggcccctggcccctccaaatctcatgtgcttttcacattccaaaaccaatcatgccttcctaacggtccaccaaagtcttaactctttccagcatttattcaaaagtccaagcctgaagtctcatctgagacaaggcaagtccctttcacctatgagcctgtaaaatcaaaaggaagctagttactttcaagatacaatggaggtacaggcattgggtaaattttcccatccaagtggaaaaaaattggccaaaacaaagaagccggaggccccatgcaagtctaaaacctgcccaggtagtcaataaatattaaagctccaaattctcctttgacaccatgtctcacatccagagcatgctgatgcaaggagtgggcttccatggccttggacagctccaccactatcgctctgcagggcacagctccgcagctgtttacataggctggcgttgagtgcctgcagcttttctaggtgcacagtacaagctggtgatggatctacccttatgaggtctggacaatggtggccctcttctcacagctccactaggcagtgccccagtggggactctgtgcacaggctccaaacacacatttcccctctgtattgcctcagtagagttcctcacgagggattcacccctgcagcagacttctgcctggacatgcagtcatttccatatatcctgggaagtttaggcagaggctcccaaagctcaactcttgtcttctgtgctcctgcaggcccaacaccatgtggaagccaccaaggcttggggcttgcaccatctgaagcaactgcctgagctgtaccttgaccccttttagccgcagctggagctggatcagctggaatgaggggcaccatgccctgaggctccacagagtagcatggccctaggcccagctcatgaaaccatttttctctcttaggcctctgggcctgtgaagggaggggctgttgtgaagatctctgacatgcactggagacattttccccattgtcttggctattaacatgtggctccttgctatgtttgcaaatttctgcagccagcttgaatttctcctcagaaaatgggtttttctattctatctcagcctggacttcattatccatatcactgtcagcattttgatcaaggccattcaacaagtctctaggtggttccaaactttccgacatcttcttgtcttcttctaagcagaatcctaaagtgtgggttagcagatcagaggagtgataaaaagcctaaactcctcatcccatccacgaagagaggcttggcagcctcctgaggaaaagctttgttctatctcatactatagcctcacatttttaaaaacaatttacttaaactcatttcccagtagaaattgaacaaggagtatttgttctgtgcagttgcataggagaaacttgaccctgccagaggaaagggctgtcccaggaacacttggcaagagagggtggtggtttgtgctgctacggaatcacagcagctattttctgcttctctctacatacctttgtgctcactaaagcagagagaggccatgagatattatacgacccagcgacctcattacactgcatttcattgaaaacctgactgtggtcccacagttctagttgagcatcagccctgacattgaattctgtttctgtatcatcttgggcaagggctttatatttaggatcacagattcctcatgggtacaataaccattcctacctcacaaaattgtgaggattcccaagaatgttgaaaatcatctagtctggtaaggactcattaaatcatctacttctctggtgacagagctgagactggcttcctggtcgccttctttttttttttttttttgtgagacttgttgcccaggccggagtgcaatggtccaatctcggctcactgtaactcccgcctcccaggttcaagtgattctcctgcctcaacctcccgagtagctggaattacaggtgcatgccaccatacccggctacttttttgtgtttttagtagagatggagtttcaccatgttggccaggctggtctcaaactcctgacctcaggtgatctacccacctcggcctcccaaagtgctgggattacagtgtgagccaacctgcccagcccctggccatctttattaaccagtgctcactgtggccatgttccttaaccctgggcctcacacagagcattgaggcagcatgctgcccaaaggcatttcacatttgtagttgggagttgacgctacttccattctcacagttacttccaacaatctgttcctttgctttcctagcccacttttgttgcttcttcctcactatactcctttccaaaggagaagaatgtgctaggtgccggcatggtgtagtgtgggaaacaaagacagacgtgggaacctcctaactctgcagacctcatggctcagtagcaaaaactgaatggtactatctgtggtaccacctggttagcctcccaccaccagtcctggaactagcattccccttttctggggaactgctccacacaaacacagattccaggtatgtgattccaggagagctttatgttgctacatgtcccaccttcctcaccacagctgactggctctggggtcagatagtcgtgatctctgcccctgtgctttgtgttcctggcttaaggttaggtacccaaggaccagcctgattttattccaggacatcgaggcagaaggaaagcatctttccttgatcttcaagagtccatgagggatttttcttttttcttttccttttggagaccgagtctttcactcctgtcgcccaggctggaatgcagtggtgggatcatggctcactgcagcctcgacttcctgggtttaggcaattctcccacctcagtttcctgagtagctgggactacaggtgtgtgccaccatgccttttttttaaaaatatttttttgtagaggggtgtttcgccatgttgcccaggctggacttgaactcctgggttccagcaatctgcctgccttggcctcccaaagtgctgagattacagtggtaagctgccatacctggccaatgagggattttaaatttcactctccagaaggaaaaaaaggagaaggattgagatatgtgtgtgtgtgtgtgtgtgtgtgtgtgtgtgtgtgtgtgtgtgtatgtgtgtgtatttggtgcagtaagcaaaaggaagaaagtgtgataacccagagctatctaaacctctcctttttctcatctgccttcccactgagagggtgtgttctggtatgcactccagtgccataagcctacaggaccctgtgggtacagcctgtggttatccagtaccttctttgactagctaatttgattagttagaagaggctatctcctgtaacaaatgtttctaatctctttagcttttaaagtaaatttttattttttgtttttatcaaggtccagtgcaagttggtggtgacaatgatgaggggacattctccataagttttccaaagttccaggctccttctccaaattggatatgtcatattgtagggtctgttcctcttcttcacttgagacatggattgcacagggtgtgtcctataaactaggccttatttggccatacatcagttattttcatattccaatagccagaaatcagtacatgtccccatcaaatcacaagagtagcttgaaaaatatggttacttgtggaccaagatgaaaacaaataagctttggtgaagttattctgccacagcgagtttctctaattggaagatttgaaaagtactatcaagttcattttgctacagacctaagtttgttcttcagtgagctgagtcttgtgtctactaattggtttcaaattcagcagggaagacacggggattagttattgagtacctaaaactgtgaacatacaggacttttcgaagtaaattttaaaaaaggagtctttactctggtgtttaagctttgatcctgaaaacatatctgaaatcacattccctatcatgtggagtcatccctcctgcagacagaattaagcttcagggtgcagcagacatgggtgagcatttaaagggaagttgacatctacctagaagacagatccactaaagttttccagtgccagagaaatgccatgctttgggcatttagaatagttcctactctgcctgggagctctatacctttatctccaaaggagatgagcactccctaattgacaccctccaccctcctgttcatgggagaatcctactggtcatccagactcacaactgtgcattaggtccatgctcatcaccgaggctaacccagtccttgattccaatcatgaatggacaaacgttttccagatatttaaggaaagtgaggaagatgcacaaatagaactaattctggaggagggaaaaaaggatataatacaggaaacagaagaaaacgttatcagaacatactctcagagtttaagaaagacaagaagtttatgaaatgagaacaagctgtcatagaggggaacaatcaggggacaggcgaaagtccttggacactagaaaagttactacagaattgacgtagcacagaggtctgatagtgcccaattccccgggctgcccatagaactcagcgtgctcccccacccccacctgtcagaagtccctcgcagctccgcaccagcccacacccgcccgaccttgtgcgctcctccccgcataaaggtctccaccgctcacttccggtcccttcgcagagcctgtgaccacactaccaccgggcccgggggacgacgccctccaccagccgccgctgtcgtccaccatggtggtgctccgaggaccccgccgctgccgccactgcccacgccgatgccactacccgctccgggcccctggcaaacccactgcttttcccctcctcccagcgcccgcgctgcccgccctgggcccgctgtcgccggtgcgacggtaccaccatcccagctgtgaggctgccatcaacacccacatcagcctggagctccacgcatcctatgtgtacctgtccatggccttctacttcgaccaggacgacgcggccctggagcactttgaccgctacttcctgcgccagtcgcaggagaaaagggagcacgcccaggagctgatgagcctgcagaacctgcgcggtggccgcatctgccttcatgacatcaggaagccagagggccaaggctgggagagcgggctcaaggccatggagtgcaccttccacctggagaagaacatcaaccagagcctcctggagctgcaccagctggccagggagaacggcgacccccagctctgcgacttcctggagaacgacttcctgaaccagcaggccaagaccatcaaagagctgggtggctacctgagcaacctgcacaagatgggggccccggaagcaggcctggcagagtacctctttaacaagctcaccctgggccgcagccagaaacacaccagagcccagacaggccccacagccacggggtgccttcccctgctcgcgccaccaggcgggacgtccatgttcccttttcagaacattctcttcatttttctcctctcagttttaccgttgttggcaataaagttatctgttctcaaagcaataaaggtgtccagctgatgcgtatctgcagcactctcaccttttaggaatcagggcacatccccatgcaggtttaaagtaggtattcagcagtctttccattcagccctgccccatctgcatgcagctcaggatctgcgggggtggaagggaaaggtattttatgggcccctggaaaatacattagtcttccccttataaactttgagggcatgtgggatggggtggggtgaggtggggtagggtggggtgagatgtgtggggtgggtggggtcgggtggggcgtgctgtcttgggccatggtatctgtgggtgtgtatgcatggtatggtataaaacatggtatggaattcatcctagcggttgcctctggagaagaagggaagggaatgagattgggcggggataaaaataatagtctttaacttgacatgaaaagttatctttttaaaacatgcaattgctaagtattcttgcttctgggcagcaagatgggggctctgggggacagtatggcagagtacctctttggcaagctcaccctgagtgacacggataatgggactgagccttaggctgccttccccacagatatggggtgacttcctgcatcttgcccttcaactgtaccatttcttccattaaactggttaaaaaaacagctcaaaagaaggactgaaaaacataaggtcaaagctgaaggtcaaatttgtgatattgaatataaagtagaataaatataaagtagaataaatgcccccaaatgtcaaggcagtgactgtctgctctgaagaatgtagaggggtggcagagagttgaaggtgcagaccaggcagagccagtatagccgatccaggtaggagactagtgcagcttgagctgtgatggtggctgaggaaatgaagagaggtcgaccagttccagatggactttcgacaaagggagacaaactttactcatggacaggaggtgaggagtgggagagggggaatataatgtaagttctgaagtttggacctgagcacctgggttgatgatggtgttattatctcccgtggggatggttgcatgggtcccccggggtggaggagcggggaatgcatgccatgtaaagtcagattttcattagacatccaagtggaaatgtgaatcaaggagctgcaaaaatgtcacgtttcgaagtagacatatgggggacattttatagacggtattgaagtcatgtgattggatgacctcaccagaaagagactataagggagagtatgagaaatctagtccaaagtgcggggcagctaacatttagaggatggttgatgtgtttgaacacccagagagttgctggtcccaccttgacctttatctgccccaagcttattagcttattcccaatgtctgcccccaagcttatctcaaaatcatcctcttcctgtgaagctcaatgtggcctctggtttctcctttcaagatatagagaaaagttcgccttttaccttttctttatggctatggatagaaaggtattatttcctagtcagaagaagattccatatggaaatgatacacctgtttgtctaagatttttttcttgttccccattaaaaactcttctcctctctcagtctactctctatttgaccaaaggaaacctccatccatgtaaaccataacattgtccatgtctgttgaaaaatacttaaaaacatctattttctgtgccacaaaagaaagttacaaagaaacaagaaacaaaaaaatcttgtttcttttgtgggctacaaaggtaaaagtcaaaaatttacagaatatatactttagtcagagacacttgggtagcttgcatcattttaaagctagtggattgttttgggcattgtattagtccgtttttcatgctgctgataaagacatacctaagactgggcaatttacaaaagcaagaggtttaatggacttacagttccacgtggctggggaagcctcacaatcctggtggaaggtgaaaagtatgtctcacatggcagcagacaagacaagagaatgagagcctagcaaaacgggtttccccttatcaaactatcagatcttgtgaaacttactcactactggtaggacagtatgggggaaaccgccccaatgattcaattatctcccactgggtccctcccacaaaacgtgggaattatgacagtacaattcaagaggagatttgggtggggacacagtcaaaccatataagcatttattaagatacaaacaagtttagcagtgcaataattatcttacacatttccatatgagtgcactgtaacacttttcttaaaaattaggattctggcactttgagttcagtttacagaaaatgctattgtccctttactcatcttagtcaaatttggtcttctcgctgtaggtctttctctgcctgctgtaaggacttctgaattctctgactttgtctcagctattacctactgaaatatatatgtcctttgactgttctcctgtggatatgagaaagaagagagcaagcattaatttttgagtgtttcaaactttaagttgactgaggggacttcttaattttctgttttggagagaaaatatggtgtagtgttttcttaacctcagattgcctgggttcaaatcccatcttggccactcattttaggtaaacttgggtaagttgtttaacttttctgtgcctcagtttctccatatgtaatatagggataataaaagcattaaccccattgggttgttgagattaaataagttaatacatgtaaatcacttagagcaatgcctggcacagtgtatgttcactatgtggtactcatggtttatcaccattatcatcctctactcttttaacttttatttaggttcaagagaacaagtgcaggtttttatataggtaaactgctgtcatggggggttgttgaatagattatttcatcatccaggtactaaaccgtgtacccaatagttatttttttgttcctctccctcttcccaccctccacactcaggtaggccccagtgtctgttgttcccttctttgagtccacgtgttctcatcatttagctcccaattataagtgagaacatgtggtatttgattttctgtccctgcattagtttgataaagacaatgggttggaagccatcatcctctacccttatgtttctttgtggtctttatgctttgggaaaatacttcacttctacacgttgccactgggggtctctcttgcatgtctagtaaccaagttgccctgcatactgagaaggaaaaaaccttagaagctgtttggttgtcaggtgtctccaggactcaggagggtacatggctgttttccctaccccccacacctcagtcccaagacaggaggaaggttgtgctgtgacaactttctgtgctatactccacaccccccacacccctattctatctcaaccagctttcccttgaatttactcctagaacactgtgcttgtgatccaaatttagagactagggtttttaaatgataatttggtgggtgggggctagcgaaggggtcatcctcattaattgggtcaaggattaagtcatgggggttgaggctgtcctcttgtgctaagtcagttcctgggtcagatcacaagaccagttaaaccagcttaccagtccaggtggaaccagctggtccaacagaatgaagggtcttgcacaccagtcttaagttttacaatagtgatgctatctatagaagcagttagggaggttatgagccttgtgacctctgactacatgactcctgagccataatttctaatcttgtggctaatttgttagttctacaaaggctgtttgggtcctcaaagaaataagggttgttttgggaggttggaaagcatggattttgcatgcatgaagggcatgaatttgggggccccaggggcagaatgctatcaactgaatgttcatgtaccctccaaatcatatgttgaagcactatcttccaaggtgatagtatttgaagatggggctgtaaggagaaaatcctggaatcatatagaaataccttcccccaaactgggagtgagctaagagatcaagaaatgacttggagaagtccagcttggcgagtagatgagattattaggattcacataggaggcactccgggacaacagcaggacagctgtagagatctgcaccgcttattatttttaaagtacttttcagctaattttctggctccttgcttactgtgtttaagcgatgagactttttcttgataggttctcagatactgtctggaatgtttgagttctcagggacacctgctctctggctgggcaacatggccttggctcatggcctggccttcagggtttgggcagcagaaataaaccttttagtaagctgattgggacccttcacactacaggggccttcaagatataattaggtttagatgaggtgaggtcatgaggaaggagcctttgtctgatagtccttacaagaaaagacaccagagagcatgctctttctctccctctctctctgccatgccatttgagcacacagtaagaagttggtcatctgcaaatcagacagctgtcaccagaaaccatgtgattaccctgttctcatacttccagcctccagagctgtgagaaataagtttctattaagcaatacactctatggtattttgttgtggcagcctgagcagacacttggggagctggaaaataatactgatgttgctgtttaaacgcactaagtcataccctcatgcaagtattggatcaaacataacataactttattgtaatttcaacattattgtatttgaaaatatttaaagtgaattggaatcctctcagttccattgattttgcatacagacacacacacacacacacacacacacacacacacacacacagacacagacacaattttgtccattttgttttatcacaaactggtctgtcttataccatggattgttaaactatagcctataagccaaattcagccaaccatgtctttataataaagttttattgaaacggagccatgcccatttattgatatattgcccattgctgggtattaactgcaaagtcagagttagtagatgagacagagactatatgacatgcaaagactaaaatatttagtatctgtaggaacagaccctaaatttacctaaaaatattcaccggagatttttaacatttcaatggtctttcactgtccaaaatgcttattgtagctttctcatacattttctaccaccactactctttggcagaaagcaattgcctgaattatctaatctaatatgctcatgatttaatcaattatctcagaaaagagattatgacagacactatccattactgatacaaaagccattctatactttcttccttagtaagagaacattgaagttttaagagtcatggtgttgacagtgtcttgggataaataataactagtcaaaatgaatcgtgaaaattgtttttctctttcaagatatttgctttcctactatttcctgctgctagagtttgccagatgaatgagttctcaccaaatacataaatggaaataacatggatttctaataaaattttacttgcctgataaatgacagcactttgtgaaaataataatttcacctcatccttgtcatgctgattgaatgctggtatggagatgtgatctttgtgcagaaacagccacttggtatccatgaggacaaggccaagggagttgcagaacccagtgtagagccctgtcataattgagtcagaagtataaactctgacatttaatatgccccagggttcctgataaataacagcagttagccttgctacttaagctactttgtagatattctatttgttatgattcatctgatataaaaagactgtaaggagaaggcatttttctgctcaaagggtacacacatgttgtaagttgaaaaagttctgaagaaccaatgtacagcatgatgactatagttaataataatgtattctatcctagagttaggagagtatatattaagtgttctcaccactaaaaagcaactatgtgaggtaatggatatgctaattgggttgattttggtaatcatttacaaggtatacacatatcaacacatcacattatataccttgaatatatatatatatatgtatatatatatatatattttgtcatgtatactgcaataaagtttcacaaaagaaaaaattaaatgcatctttctccttgcttttacatagcaagtatttgtcaagcgcatgttacgttaggtaccatttcaggtgctttccagacattgcctgtgtccttctcacaacaaccctgtgagacatggatctcccctattttacatcgagaaaatggtttcagagtagtgtcactatctgaaaccttatagttagtaggtgatagagtcagaatcacctggcttcagaaagaggtaatgtctttgcatcatttctgttctgctgtcatctcaattccttgttccacatgccataggagactttatttaagcaacagacctgtggaattggtctcttcgtatctttttaataaataaatggcaggtttgtgcgttttgtgtgtgtgtgtgtgtctgtgtgtgtgtacatgacccttccaggtgttcagactcagagtccgtgttctctctgttgcatccagcccttaatgatcaatttcactctccatgttcactaaacacacaattccataaaccttgtctgcatctctaactggctgctatctcatgctgtaattcatagccagtattctagaaaaggttacctgttcttgttgacttcccaggagtaatgaatttctttaagtgttgggagaagtaatatatccacaatgttcagaaataaaacatataaaagggtatattatgaaggcttctccctgtccctgttttttgagggggaggtttctgtatatccttatatacatttattttacggagttatcagcatacatggatatataccctcccccctcacccagacagttgcttaattcacagcaccccgcaccttgtaccactgggcacacctagctttttggtttggtgagttaaataacacccagctgtgatgggcgcttcaggttaccctcaagcaggaagtgaaagctatggctgtgctgtatactgccaagctgaaaatggaaagttctttcttttgtttgtttgtttgtttttgtttacttttgtgttttttatttgtttgtttttgcaggcggggcaggtggtgacagagtttcactcttatcacccaggctggagtgcagtggcaggatccccgctcactgcaacctctgcatcaactgattctcttgcctctgcctcccgagtagctggaattactggcgaccaccaccacatctggctaattttctttgtatttttagtagagatggggttttgccatgttggccaggctggtctacaactcctgaccttgtgatccgcccacgttggcctcccaaaggaaagtgtgttctaatatgcacaaagagcccatctgtgaaaactaggggattgtttcttgttttgttttgttttgttgaggaggggtggttctagataagaactctttcaattcacaagctgaccactacaataacaggaatgagatgtcggtggccacacatgacaaagaatacagatgttacaaaatgagttcaacaaagtcactaaaccagcaaacaacaactggaacaaataacaaaaacaagcgttggagtctcagtctgttcatgctgctatatcaaacttccacagagcggataatttatgaaaaccagaaatgtatttcctatatttgtagaggctgggaaggccaagatcaagactccagaattaggcatctagcaagggtcttcttgctgtgtcctctcatggcagaaggagcaaaaaatgataaaagggatgaactctatgtcgtcacatagcagaaagatggaagagtcaaaggattagtttcctccagtgctttttaaaggtcactagtaccagtgatgacgaatctaccctcacgacttagtaacatcctaaaggcctcatctcttaatactactacattggccattaagtttcaacagatacattttggagggcatttagataatagcagatgggctgagggaaaagatgatttctagaattgccacttaataatgttaaacatgtccagttttcaacaaaagaatataaatcatatcaggaaacaaaaagtattgcccatacatgagaaagaagaaatcaacagaaactgtctcagaggaaatccggtcagtggatttactaagcaaatattttaaatcaactctttgaaatattaaagaacatcatttagaaagaagaaaagaaaaccaggagaatgatgtctcatcaaatacataataccaataagaaaatagaaatgatataaaaggaacaaaatagaaattctggaatggaaaaggataacaattggaatgaaaatttcagtagagggagtcaatagcaaatttgaataagaagtagagagaatcatcaatctccaagaaaggtcagttgagattatctagtctgagaatctggaagaaaaaaaaagaatgaagtaaaattaacgaagctcagagtacttgtggaaaccatccagtgtaccaaaacatacataaagggagttctggaaagagataaaaaggggaatatgaagggatataaagaatatttgaggaaagaacagtcaatatcttatcaaatatgatgaaatatgttgatttacacatccaatagattccatgtagggaaaaatcagagatatccccaccaagacactataaacaaaaggtaaaaaagacaagacaatgaaaacatcctgaaagcggcaaaatagaagttatacttcacatacacaggatgatcaataatattaacagctgatttctcaacagaaagtatggaggctgtattagtctgttttcattgctataaagggatatcagaggctgggtaatttatttaaaaagatgtttaattggctgatggttctgcagactggacaaggatggtactggcatctgtttggcttccagagaggcctcagggacctttagctcatggcagaagacaaactggaagtaggcaggtcatatggccagaaaaggtgcaagagaggtttgggggaggcatcacactttacaacaatgagatctcatgagaactcactcactattgcaaggacagcagcaagccatgagggatccacccccatgaccaaaacaccccccaccaggtcccacattgtacctctgggaattataattcaacatgagatttggtggggacatatatttaagctatatcattctgcccctggcccctcaaattttattttcttcttacattgcaaaatacaatcataacttcccaacaggctcccaaagtcttaactccttccagctgatatcaactcaattaaaagtcccaaatgaaagtccaaaatcttatttgagactcatctccttcctcctatgagcttgcaaaatcaaaacaagttatttacttccaagatataatgatggtataagcattgtgtaagcactcccattccaaaatggagaaatcggccaaaggaaagggcctacaggccccatgcaagttcaaaacccagcagggaactcattaaatcttagagcttcaaaatagtctccttacactatatattgtgcatccagggcacagtggtgcaggggatgggctcctatggcctttggcagctccacacctgtggctttgcaggattcaggacccatggttgctttcacagcttgttatgtgcctgtggcttttccaggcacaaggttcaagctgcctgtggctctaccattctggggtctggaagatggtgtgccctttccatagatcaactaggtggtgccccagtgggaactctgtgcatgggctcctatgtcacatctcccctccgcactgccgtgccactgcagcagacttctgcctggacactcaggcttttccattcatcctctgaaatctaagtggaggctgccaagcgtccttcagtcttgcactctgcacacctgcatgcttaatgccacgtggaagtcaccaaggctttgacttgcaccctctgaagtagcatctggggctgtgtctggggtcatctgagctgaggctggagctggagcagcctggatgcagggagcagtgtcctgaggctgcacaggttactggggcacaggttagtgagattttgcagggacatatattcaaactataccagaggcctagaggtaggaagatgacatattcaatgtgctgaaagaaaaatactgctgatgaagaattctacattccacaatgtatccttcaaagaaatcaaaaaataagtcatcccaagataaacaaatttcaacagtgattctcactagtacacttgctctgcaggaaatgctaaagggactttactgctgaaaaataaactgacaaattaggaatttcatagggttcaaacttaatatatccataaacttcatgtagaaaaaaaagtatcaaatacttaagtataatgactaaatagtgttgccaatcatgatatttctagaaagtatgccataggatacccatttcatgaaaaataaagagctgaactttttatggtacatttttcacaaatccataaccattaggaagcactcctttatacaggacttgtactcttggaacagcaataggaatctccgaagaaccagtactcctgggatcaatttatggctagattagtttcgcaagtcaccttcttcatatttacaaaggcaatcttcaagttctttttgtttttccttaacaaatcaaacataaaagcaacttgaaaaagtactttagtagttccatgttgtcttgtatgtaactctgccattttatttttctaatcaaaatggaagaaagcataacttgtgctcttctgctgaatgcagtgctttgctctttaaagctgtgtctcacataactgctagttgacataaagcattctctcaacaaaaaccatttactcagaataaaatacagacactctttctttcttttcctcttcttcttgtgtgtgtttttttttttgaggggacattgtccatatgttattcaaagttccaggctccttctccaaagtggatatgtcatattgtagggtctgttcctcttcttgagacatggattgcacacggtgtgtcctataaactaggccttatttggccatacaccagttattttcatattccaatagccagaaatcagtacaagaccccatcaaatcacaagggtagctaaaaaaatatggttacttgtggaccaagatgaaaacaaataagctttgatgaagtcactctgccacagcgagtttctctaattggaagatttgaaaagtactagcaagttcattttgctacagacgtaagcttgctcttcagtgagctgagtcccatgtctactaattggtttcaaattcagcagggaagacacggggattagttattgagtccccaaaaccgtgaacatagaggacttttccaggtaaattttaaaaacagagtctttactctggtgtttaagctttgatcctgaaaacatatctgaaatcacattccttgtcatgtggagacatctctcctgcagaaagaattaagcttccgggtgcagcagacatgggtgagcatttaaagggaagctgacatctacctagaagacagatccactaacatattccagtgccagagaaatgccatgctttgggcatttagaatagttcctactctgcctgggagctctatacctttatctccaaaggagatgagcactccctaattgacacactccaccctcctgttcatgggagaatcctattggtcacccagactcacagctgtgcattcgatccatgctcatcaccgaggctaacccagtccttgattccaatcatgaatggacaaacgttttccagatatttaaggaaagtgaggaagatgcacaaatagaactaattctggaggagggaaaaagaggatataatacaggaaacagaaaaaaacgttaccagaacatactctcagagtttaagaaagacaagaggtttataaaatgagaacaagctgtcatagaggggaataatcagggggcagacgaaaaagtccttggacactagaaaagttactgcagaattgacatcacgcagtggactgacagtgcctagttccctgggctgcccacggaactcagtgtgccccccctcgccaccaccaccatccacccgacggcgcgcgcccctccacccatacgggtccccacagcccacttccggtcccttcgcagaccctgtggcaaccaccaccgcctggtcccgaggaccctgccctccactggtcgcctccgtcgtccaccatgttgtgctcagaggcacccgccgcggccgccactgccgatgccgatgccgccgcccgcttcgggaccctagcgaccacaccgctttaccctgcctgctcctcgcgcccgcactgcccgccctgggcccgctgtcgcaggtgcaccagaacaaccatctcagctgcgaggtcgccatcaacatcaaggtcaccctggagctccacgcctcctatgtgtacctgtccatggccttcttcttcgaccgggacgacgtggccctggagagcttcagccgctatttcttgcaccagtggcacgagaagagggagcacgcccaggagctgatgagcctgcagaacctgcgcggtggccgcatctaccttcgcgacatcaggaagccagagtgccaaggctgggagagcgggctccaggccatggactgcgccttctacctggagaagaacgtcaaccagagcctcctggagctgcaccagctggccaaggagaacgacgaccccacctctgtgacttcctggagaaccacttcctgaaccagcaggccaagaccatcaaagagattggtggctacctgagcaacctgtgcaagatgggggccccggaagcaggcctggcagagtacctctttaacaagctcaccctgggccgcagccagaaacacaccagagcccagacaggtcccgcagccacggggtgccttcccctgctcgcgccaccacgcggggcgtccatgttgtcctttcagaacattctcttcagttttctcctctcagttttactgttgttggcaataaagttatctgttctcaaagcaataaaggtgtccagctgatgcatatctgcaacactctcaccttttaggaatcagggcacatccccatgcaggtttaaagtaggtatccagcagtctttccattcagccctgccccatctgcatgcagctcaggatctgcgggggtggaggggaaaggtattttatgggccgctggaaaatacattagtcttccccttataaactttgagggcatgtgggattggatggggtgaggtggggtggggtagggtggggtgaggtgtggggtgggtgaggtcgggtggggtgtgcagtcttgggccatggtatctgtgggtgcgtaaacatggtaaggtgtaaagcatggtatggaattcatcctagtggttgccgggtgctgtggctcacgcctgtaatcccagcacatgggaggctgaggcgggtggatcatctgaggtcgggagtttgagaccagcctgaccaacatggagaaactccgtctctactaaaaatacaaaattagccgggcatggtggtgcatgcctgtaatcccagctactcgggaggctgaggcaggaaaatcgcgtgaatctgggacgcggaggttgtggtgaggggagatcccgccattgcactccagcctggacaacaagagcgaaactccatctgaaaaaacaaacaaacaaacaaaaaacaaaatatgcaagtgctaaggattcttgcttctgggcttcaagatgggggctctcgcggacagtatcgcatagtacctctttggcaagctcaccctgagtgacacggataatgggactgagccttaggctgccttccccacagatagggggtgatttcctgtatattacccttacgaattctccattcatggtttttccttcaattgtaccatttcttccattaaagctggtttaaaaaaaaaaaacagctcaaaaggactgaaaaacataaggtcaaaactgaaggtcaaatttgtgatattgaatataaagtagaataaatgcccccaaaatgtcaaggcagtgactgctttgaagaatgtagaggggtggcagagagttgaaggtgcagaccaggtagagccagtatagctgttccagttaggagactagtgcagcttcagctgtgatggtggctgaggaaatgaagagaggtcgaccagttccatatgggtttttgacaaggagacacaaactttgctcatggacaggaggtgaggaatgggagagggggaatacaatgtaagttctgaagtttggacttgaacacctggattgatgatggtgttattatccccctggggatggttgcatgtgtccccggggtggaggagcggggaatgtatgccatgtaaaatcagatttttattagacgtccaagtggaaatgtgaatcaaggagctgcaaaaatgtcacatttggaagtagacatacgggggactttttatagatggtattgaagtcatgtgattggatgagctcaccagaaggagactataagggagagtatgagaaatctagtccaaagtgcagggcagctaacatttagaagatggttgaggtgtttgaacacccagagagttgctggtcccaccttgacctttatctgccccaagtttattaccttattcccaatgtctgccccaagcttacctcaaaatcatcctgttcctgagaagctcagtgtggcctctggattctcctttcaagatatagagaaaagttcaccttttacattttcttcatggctctggatagaaagatattatttcctagtataaagaatatttcatatggaaatgatacacttgtttctctatgttttcttttttcttgttcccctttaaaaactcttctcctctctcagtccactctctatttgaccgaaggaaacctccatccatgtaaactctaacgttgcccatgtctgaggaaaaatacttcaaacatctatcttctgtgccacaaaagaaagttacaaagaaataagaaacaaaaaagtcttctttcttctgtgggttacaaaggtaaaagtcaaaaatttacagactctatgctttagtcaaagacacatgggtagcttgcatcatttcaaagctagcaaattgttttgagcattgtattagtccatttttcaggctgctgataaagacataccaaagattggacagtttataaaagcaagaggtttattgaacttacagttccacatggctggggaaccctcacaatcatcgtggaaggtgaaagtcatgtctcacatggcggcagacaagagaagagaaggagagccaaggggtttccccttatcaaactatcagatcttgtgagactcattcaccaccagtaggacagtatgggagaaactgcccccatgattcaattatctcccaatgggtcccttccacaaaacatgggaattatgggagtacaattcaagatgagatttgggtggggacacagtcaaaccatataagcatttattaagatacgaacaagtttcgctgtgcaacaattgtcttccacatttccgtatgagtgcactgtaacacttttcttaaaaattaggattctggcactttgagttcagtttacagaaaatgctttcgcctttttacacatctttgtcaaacttggtcttctcactgcatctctttcgctgcctactgtaaggacttctgaattctctgactttgtctcagctattacctattgaaatatatatgtcccttgaccgttctcctgtggatatgagaaagaacgagcaagcattaagttttgagtgtttcaaactttaagttgactgaggggacttcttaattttttgttttggagagaaaatttggtgtagtgttttcttaacctcagattgcctgggttcaaatccaatcttagcctctcattttgggtaaacttgagtaatttgttcaacttttctgtgcctcagtttctccatatgtaatatagggataataaaagcattaaccccattgggttgttgagattaaatgagttaatatatgtaaatcacttagagtaatgcctggcacagtgtatgtttacaatgtggtactcatgatttatcaccattatcatcctctactcttttaacttttatttaggttcaagagaacaagtgcaggtttttatataggtaaactgctgtcatggggggttgttgaatagattatttcatcatccaggtactaaaccgtgtacccaatagttatttttttgttcctctccctcttcccaccctccacactcaggtaggccccagtgtctgttgtttccttctttgagtccacgtgttctcatcatttagctcccaattataagtgagaacatgtggtatttgattttctgtccttgcattagtttgataaaaacaatgggctggaagccatcatcctctacccttatgtttctttgtggtctttatgctttgggaaaatacttcacttctacacgttgccactgggggtctctcttgcatgtctagtaaccagttgccctgcatactgagaaggaaaaaaccttagaagatagtttggttgtcaggtgtctccaggactcagaagggtacatggctgttttccttaccccccacacctcagtcccaagacaggaggaaggttgtcctgtgacaactttccgtgctattccccgcccccgcccattctatctcaaccagctttcccttgaattcactcctagaacactgttcttgttcttcccaaacccaggttgcctgagtctcctgtttccatcctgaacttcctcccactcttcagagatggacaagagcaacaggatgaagtgctcaccctgatccccacctttgtctggatgtttggagctgaaaaggagaggaatggctaggtgggcactggggggagaatgagaaaaagagaacacattagggccactgacaacataagtaaaatccacatatcatcatgagctttggcatagaggctctcaagctttgctgcacatccaaatcacctgcagagcttttgaaaatctcaatgtccaggcagcatcccagaccaaatacataagcctctggcgcagggcctgggcatgccaggcattgaaaaccagcactagcatctggctgctcaaaatatggtctgtggaccagcagtatcaatctaaactgagaacttgctagcaatgcaaaatttcaagccacaccccagggctacggaatgagcatctacattttaacaagactctcggtgatcaatttgcacactggaatttgagaagcactctttagcaccctgattgccaaatatggctgcaccttgaaatcacctagataacctgaaaataatactaatgcctggacttaatcaatgtgctcagctatggagagtgagaaaaaataaaaggaaaaatagaaagacaaatagatgctaaagaaaggtgaaaagtttagaatatttggtagctttaggtgaattcagggttgcggcaagttaccataaacatggattggcaaagactttctataaagaatgagatagtaaatgttttaggctttgcagctactgcaaaagacctctgtctcaactacaaactctcctgctggagtgaaaaagtaacgacaaacagtaggtaattgaatggggtggctaggatgtttggggctgaaaacattgaacaatgcctgactagcctttttgacagattcttcataatcacatattcatcacggaggctgtttaaatcaatgtgctcagctataccctcatgtcagtactagaccaaatacgataaaaacttactgtaacatcaacaattactgactcaacaataattgatctctgtctcacacacacactagcttttatctattttgttgtttatcacaaactggtttgttgtatagcatgggctggcaaactacagccagcaatcctaatctggcccccacttttttggtaaatacagttttattagaacacagccaccgcattcaattacctactgcttgtggctactttttcactccagcaggagagtttgtagttgagacagaggtcttttgcagtagctgcaaagcctaaaacatttactatctcattttttatagaaagtctttgccaatccatgtttatggtaacttgctgcaaccctgaattcacctaaagctaccaaatattctaaacttttcacctttctttatgcatctacgtgtctttatatttttccttttattttttctcactctccattaatattctagaatgatttggatatttgtaatattttagacacatagggaacactcacacttactagaatttcaattgtttcctttcagactaacatctttgtatatttcagcaattcaacctcttgcctttgtgtcttcagtttagcctgtctcttgctgtgcctttttttaattgagggacatcagtcatcctgcttctggaagcatcagagtggaacaatgcctgactagcctttttgacggattcttcataatcacatattcatcacagaggctgtttaaagtgtgctcgttttcaagttattacaatctattcccatcatttttctgtctgtgaggcatttaaattttattaatatgcaaagctacttcctggcatgaggagaaatagacttcttcccttttatatctatttcaaattttgtgttttataatgttggttttggtttataatctattgtaatgatatattaactgtaccacatgcaccaaggatatttatttttttcccttgggatacttctctgtgcatgagtgttttcctcccaaatgtttaattattgtatgaagtatactgaaaatcagaagttccaatttgaaacatgtattcagaactataaatcaagaaattgacttaaggtaaacatttttaggaagggagcattcatgcagttatttcttttcagccaaatagccattctttccgcaatttatattaggttctgtcatgtgttccacacgttatgcttgacactaggaatacaaggtgactaggacacagattctggtcacagtcggacagacatacaaatagatgcctccaatatatttcagtatgatctacaaaagaaataaacacaaagtgctatgcgactccaggagagaaacgggatctaattctcacctgaggagtcaggaaacacctgctgtggaggtgacattgactcttgaaggatgaattggagttccacaggtggagaagagagaagagagtactttagttatgcttctttgctgcataggagccaacagagagggaacagttacaaacacaaggttgtaaggggatctagttgatgaggtgatgtatttactagacacagaaggaaggatacattgttttatattttaaggaactccataaaaccctcctctgaaaggtcatcactgacttactagttaacatcaacactggtctcttttcagcctttgccctgcttgatcactctggagccatttaattgtgttggttagtccttctttccttggttttcctgtcctctcttggtttgccaaatatttatctatagagaactacatagatttaataatcctcttggattctgcttttggcctcttcaactcttgctctgtgtttatttccccctgagcctagccacccccagtggccagtttctctctctctctctctctctgtatgtgtgtgtgtgtgtgtgtgcgtgtgtgtgtgttctagatggcttatcttgaccatgacacttgaacagccacctatgaaacatctccctctgggtgtacccagaacactcatactcaacaagtcccacaattaattcattgtctttttctcaaatactcactagatttgccacaccttcccctacactcacaagtaacacattttatagtcaccctagatttatggttcttactcagcctgaatatatgtaatatctctcctctccatatgctcttctccccctgtatgggccttatctttttcaggctatgatgatctatgatctaacaatttttctaatctctgtaccggtcaaagctccctaaccacaaaatttgaccctggctagtcaaagcagaaaagaaattttttaagaaggatataccataacgaacttggaaggctgtaggaccaggctcagaaatgggaagcatcatgcaaaatggagccttgtctgccatctgtcttgtcctattttctcaaacaggaatggtgttcagatgttgagctgcccaaagtattaaacatataatctagtttttctaaccctctgttaatagatgatattggtgctcttcccagatccacttgaccagcagaatacccaaatgctcagacacttgtgagcacttcagctgatggcttatgcctgtgaccttctcggaaggaatacccttggctaactgggacagccaatggctctgtgacacagaggtacaaaagcctggacccttccttttctctctgctgtgagatttatgctacaggatctgccttgtgtgaagacaaggttagacattgaccaagatcacttatttccttgactccttcccctgccctatcttgcactacgtgtttcctccagagcgcatgcctttaataaatccctgcctcaagctccgcttccaaggaacccaacctaagacccaccctcaaacagagttgatcaccttctcctttgtcttacctccatttatactacatttcttgctaatggcacttgccactctgtatggcaattgtttcttcatatgcctggatcttttaataggctgtagaacactggagtgcaggaaatgcaggaattttttctctcattaagccctagtatatatataaacaggaaattaaaaataataagttgaacttaattgaaaataaaagtcagatcacagtggattaaagaatgagtagaagtgaggtagtggaactagttattatagtgcaaggttattctttccaatgtccaaatgttccttggaatattattattggcctacctgttttatccaccaactagattgtggataactgaacaaaaatacatttttagtaattagtctttactcagaaggattttttacaagacataaagttcatgcaatctggttaatttcccaaatgagtcacatatattctttctttctttgttagctttgttattacttactcaggaaggggtcgcttttgaaatttgtgacttagcaatttcttccacttcaatgtcaaaaataacactgcatggccaaggctagggatttcatacatttctttagcatttttgaagcctacattccttatcactctagagacattatgtaaaattatttcatatttgacaaatgattccagtttgattatcattttgcctcatctatagaagtctgtgtgtggtggatgttggacagtctaataatttactgaacatttgctgtatacaaaatactatgctatcaattgttgggggctagcaggttgacaagtaatataaatagtctctatgctgaagaagattgagctagctagaattgtggcatagcttagaataatctacagaggacctcatcaatcaatttcaaattaattaataattgatgctgagcctgtaaggaccaagagggtacagcatgaggggatgattagcaagaactaggtcaataaacaaaagaagttttctggagagaagtttgcttaaaatgtgttgatgaacctcaatttaaaagacactttcttaatattcctgtctagccaatgccctccttcttgtctctaccctagaattcccaagacatggacaagaattcatagaattctgactatgccataatcaaacactggaaggaattgagtaggtggtgactagtctatattttaagttgagagtctcactgggctgccacttggtgtgatgccattggcccaagttctgaccctcatatttataaaaccacaggtttgactttctcagtgaacccaaaggtgaacagcttctccgtgagtgatcagcagactttttctataaagtataaatattttacaatctacaggccatattgtctttgtcacaactatttaactctgctgttgtggtgtgaaagtagccacagactatatgtagatgtggctgtgttccaataaaactttatttacaaaatttaaaggccggccagatttagcctacaggctatagtttgccactccctgttgtagaagattgactcacaccaacaatatttccaagtcattaatcagtcaccaataggactcatataagcaggacagattattactgcatctttgatcagaaattggccactagagaagctcaacttcaaatcagaagtttgtttagtaagcaacaggtgaggcaaatgaatgttttggtttgtgttcttacagaagtgaccctgatatggtttgggtatttgtcccctccaaatctcatgttgaaatgtgatatgcaatgttagaggtggggcctggtggaagtgtttgggtcatggaggtggatccctcatgaatggcttggggtcctccccatggtaatgagtgagttcttgctctattagttcatgggagaggtggttgtttaaaggagcctcttaccttctcctctctctcttgttccttttctcaccatgtgacatgcctcctccccctttgcaatctgccaaaaagtagaagcttccggaggcctcaaccgaaaccatgaatatgctggccccatgtttgtacactctgcagagtgatgagccaaataaacctctttgctttataaattacccagtctcgggtagtcctgtatggtaacacaaaatgaagactctgaggcaatggtttaaatgtaagtaatttatttggcagataatcccagcaactatcattaaggaaatagagaaataaaaacaaggaatggaaagaagccaataaaatttgcattattaagcaagatcaccaaagtcaaggagaacataatctccctgggagaatgtgcctctgatttataccagtcatggcacaagggagctgggatatttatccagtaactcgatccatcattggttgggggttgcttgtggggaggatcagaaagagccccactgtccaaagaaaggcttcaggctgagggttgtaggtgctggcagctggaagttggacagcatgtatgaacatggtaaatgccaaggggctatggagggagggcaccaacagcatctgttagacttgttttctcccaaatgatattcataaggtagcacagcttactgagtaaattttctattacaagattttttttctgtataaatggaactgctcctgtaaatccaaccaacatcctctccatggtatttgataggcattaacacatatttttaacagttaatccattttgtgaaatagtttcccttaaccatagttggtataatcccaagatagaacatattagaattgtcatgaatatagctttttcaaattgttttatattttgtttactaatatcttttttaatatttgggaatcatggggcttgggactgaaagtggaccaaacctcaccccactcttatttggccttggcgattcagtgtactatctgtgctctcttgccatatttattgctagaggcagccaaaggctggcctgtgggagtaactatggaaaacaagagtgtgtacacactctctgaggacacaccctagttttggaacacaaccccataaatgaggaactccacaatgctggcatgtccagggcaaagttcttaggctgttccattaactttgtgcaccacttccattctccttgaagccaaccaacagcagtctaagcctaacagttgagctcatgggctttggcaccatgcagacccaaggtagattactatctcagccacttggctttgctgcatgacatattcattcagacataaatgtcaataccttcctgggcatcctgtgaaaaatccactttcacaaaagcatttcaggacaatgtagactttcttaacatttcacagtagaggccaagaaagagttcacatcattttcctcaaagcaatcaacttaaaaatttcaattgacatttatattctcccaagtcccttcttggccttcctgatacaacgattttctctctgtccttcatacaatgctcaccgttataggctccattctcttcatccttcccctcacttcttttctcttccattgtgatatgcagttgagccccacttagctctccagctcatcaacataaagggttctccagttaataggacccacctgccttagaagagaagtgggattatgtgttatttgtggcaaggggtaagggatgagaattatttcatacgcctcatgtatccataaaggacttctacttaatatgtatttttgtgtgtatgtatgtttccactttattccctgagaactaatcacatgttggtaacactgccagcctctctctgctcctttgtctattcctttccagtagtgaagaagcacaacttttctgatcagaaacagtaagaaaaggaacaaagtagatgtgtatggcagccattcaggtgtggcacttgcagaacctctcaggaaagaatttgccactcagttgcaaggagtgcagctggttgacagcctccaacttttgaaggccacattcttctcgggaagcctagccaatgaggaaacacagaagaaatgctaaggcctgaccgtttctgccaatatgggactcaattaacaggaattatttgctttggagctgccctaggtgttgactgagactttgtcaaatctgcattgagatcccaggcttgccctgaccaaacttactttctccccttcgctcaatcttgctttctcacctctttcctttcataggtgtcatagccacagcatggtctaagactttccctgcccagttttgcttcctctccctttcatctttcataagatttacctccacatatactgtttgcactactaactctgtctcagagtctgcttccaaaaagacccaaataatacagtgtggctctacagctctacttctctttttctgtctctctgtctctctcttataatttgtacagaagattcaaacactcttacaatctccatgtgctgcatgtcttagggaatgtttttctgctacgagtgggaggctggattcttgggtatattgttaggggcacagttttggggggcccattatgactacatatctagtctcattctgcaattcaatcttaattcgacaaaggtgattttttatctctgttttattcctgtgttttatgtctcaattagtttgtgactctggagagaaataaaaagggctgctttatttatcctttccaccccagcatgaataggggttgaatatttaaaaattcttatatgtaatttagaagacttgaatgattttccaaaggccacatagggtattcattctgctctattcttatgaactcatttaaaaaattcatccaaagcatgatcttaaaaagtaatgaaaactgagcagagtgacagaaagaatttgattaataaagacactattgcaataattacttctgctgatggacttattgcttccttgaagatgtaaggatagaatgtatggaccgtgagcatgaggctttcctagaattttagtgtgtgtatgtatgctcagtgtgtgtgtgttgcggggtggttccttggtcctatacaggttgttcggaaagaggcactagcagaccagttttagggtaccagtcctttcacattcctgtctttgggaatcactgtgcatacagtttttgctgaagtgttggcctagggcactccaaccttccctaccagctgcctggcccagcttgcctcaggtgccttccctgtagtgtcactcattgttgctgccccatctgtaacctctcagcttatccaggagagcatgtgcaacttccgtggacagttacttcttcctatactaccagaggcttcttaccttaagtacctgtatttctgtgacctaggacattctctggctatgagagtatgctacactcacttgtgaggcaagccaggaagggccaggcaatttaatgacctagaagtgactttcacaaatgaagaacagaatttggtgggtacctctccaatttccttccttctcttggagggataattctagggcatgatgtctcatgattagcagcatgagagatagcaaagcctctcagcaggtccctagtggattgagctccctcgtaataactcactcatgaatgtgccttttattgaatgtcttcccctttctcatttttcccctctatgcttcctggtattactccttgctatgcactgaatgcttgtaacccctcaaaatttacatgttgaaatgctaatcttcagtatgatggtatttggagatgaggcctttggaaggtaatcaggttactagggcggagccctcattatgtgattaatgcactgagaagacacgagagaggttgttttcctccttctctgctctccaccatatgaggatactgcgaaaagactaccagtttcaaaccagaaagagagctctcaccagcacccaaccatgctggcatcctgatttcagactgctggctttcaaaatagtgaaaaaaatattatttttctttcagctacccagtctatggtaatctgttttagcagcccaaactaagacatcccctaaataaactgcttgtatctaaacccttctcccaggatcatcttttcggagaactcaagctaagatactacccccgctcttaccagattttttggggaaattaaaagaaagggtgagggtaagaaaacagaaaggagcagacatgtggaatttagcggagttgcagaaactatggagatttggggtgaagaacaaggaactcctatggtgactttctccaaaaaggctttgagaaaacaacccctctctattaccaactcccaaggcacagtctcatatccatgagcaaccccacttctagtttatgtgtgattcagttttttccaagctaaacctgcttgacttgacgagaaggccaaataaattcaagcttgctccaaacatgtctctttagatcaggttattctcatttgtaatgaagaaactgaggcagctagcaggttgatcattcgtaacactcttttttaactataacattctaaaatgtgggagcagctctcgtcccaatagcaatccatgattaaataactatgaagtttggaagttgggcctgtaaacatttctatagagagctacttcattcattttgttttattcgattcatgttagtttctaatcagttcccaaagagggtggagtatcctctttgaaggcccatagttttatatgacttcacctttctcagacaacccagtgatttgtaatcaagaatgaatatttctgccaagtaaaaaatgtttaacattatcccagcttagtaaggggaaaggcaggggataagggtgggtagcaggtagaaccttcattagagtgagatggctccctgaggaaaacaactgcaactgtgtttttcgagttctattctcaattttttgttttcttttttgagaaagagcctggctctgtgactcaggctggagtgtagtggggcgatctcgactcactacaaccttcgccctgctgggctcaagcgatcctcccacctcagcctcccaagtagttgggaccacaggcatgcaccaccacatctggctaattttttgtaattttagtagagatagggtcttgccatgttgcctgggctggtctcgaactcctgagctcaagctgtctacctgcctcagcctcccaaagtgttgggattataagcatgggccactgtgcccggctcaagctctgttctattcagccaattacctcagcacaggacagggcaaggaaatggggccggggaaggggtccctgttactatggttggtgccttgggaaatatattccttggggctattattactgcctattacataagtaagctcaattaaagccaggcttatcagtcaaaaatctctgcaaccaatcaataaaggactcaggatatgcaaaccgtagtgtcatccaactcatgtgtttttagattttgagataatattttttgaattcctgtagaggaaggaatacctacatagcattggctcctaagaaagtgactcagcaggccccatcaaagattgccattgaatcaggccgtagggtttggcaggaggaggagggctggagaatagtacaagctgagggctgaatcacactggctggcactgcaaagaaccccatctaactctagttaatgccagcattccatctagtttagctcacaaatggattttaggtacttcctgccatgtagactttcttgcttctcatgctgtgctgaaaataacctgctaagaaacctggaagacccccctccccttgcttaaccaaatgtcaaagatttattaccaataatggacaaactaacatcatgtgcctcttgttgtggtgctgtaacagggacacacagccatttaagtagtatttctgccagaagagtacctaaaccaactgtaatcatgaggaaacatcagacaaactcaaactgagagatattttacaaaacagcaggcctgtgttcttcaagaatgtccatgtcataaaacacaaagaaagactgggaactagtccatgttaaaggaggccagagagacgtgacaactaagtgcaacacattaacatggattatatttaggaggaaaaagaatagaatgaccagaaaaactttgttgcaacaactgtgaaaactgaatatggactgtatattatataataaagagcatggtatcaatgttaaatttctggaattggatacacgtactatggttttgtaagagaatttttttcttttgtttgcttttcttttaatatttttagagacagggtcttgctctgtcacccaggctgccttacattggcttggtcataggccactgtaaccttcaactcctaagctgaagagatcctcttgccttggcctcccaaagtgctgggattacaagtgtgagccatggtgcctgtcccagaattcttgttcttgggaaatatatgaagttagctgcatctgtctgtctcttcattcaggtatttcagtgtgtgtttgtgtgtctgtgacacacatttgtaaaatgttaaaaattgatctatctaaacgtagaaagttatgtgtattatactttataataacactttgacagagaaacaaggacatcgtaaaattgtacccagctggtgtaagtggtgaaactatcaatccaaatacatggaatattgtctaaagtttataagaaccaaatttatacaaattatatgttaagattatggcgcaacttaatggaagtcttatatttatatttgtatacacttaaatattattataattaataaaaacttaaccaatctacaaatgaagtgtaagaaatttaggtatttatcttaactgttttcaagataattaataaactaaaagtcttagacaaactacagaaagtcatgtgtattgtatatgcaactattttgcaagttttaaattatttctaaacaaaaatttaaacaataccaaattatttattattattattttatgaaaagtaaattacatacagaaaatttttctgcaagatcctgctcccatagtaaagtagaaagggaatgggcctggagcacctgagaactggttactcctagctccaccattaaataactgagcattgtgggagaaagtcactaaattacccgagactcaattttctgtaaaatcgactcctcacatttgcaggacttctcttcccacatcttcactctaagaacaccaaatcataaactccttttcaagtgtatttattctttattgattaatttaaatatagcacccttcttcctgagagcaaagccacaaaccaccaacaatgaccgacttcaaaataaatgtctgcaaatgcaattaagtgcattttagaatagacttgtactaacaggaagtataattaactcagaggcattcttatggagtaatcccaggtttgttatataggttcatttcatccataaagtcaggagaatacaattgagttgtacagaacatcagcatatctgacacattttaataagggagatacagattatatcccaaataaattaagaaatggcaaaaaatagtaatgaatagtttcgttaacaaattatgacatgatctgctggcaatattagtctgactcctactgatgcaataaggctgacagctagctgcaaaagtaattaatctgaacagaaattgactgtgaactgtgcttggcttaaacttggactaaccatcctgctgacctaagagaaatccatgcagtaaattgcttcaagagacacaggatacagaaaattctgctttaaaatggtaaagtatcattttcattttgagacctactttcaggcactaaattaaattttagatgacctcagcttttatcctgtctctaaaagatccaactcagaaatttgtcatgcttccagtttccaaaacctagtattggtagtttttctgagatgaattccaaggctcgttcagcttggttaggtaattatagttattatcatgaaaaaaactaggtcagatcagttcaattttttttcttttttcttttgcaaaaaagaataatatgtgaatgttttagacaggtcattttgtattcagcaactaactctggcttttattacttggccacgacattggtagaggtcaactgcaaagcaatgagcaggcaggctagagtaacttatgtcaggcgtgtgacagctgcatagtgttgcagcattggctttttcctcaacacggatatactgagctactgccccacctccaactctgtcatcttggaaaagtgagtttatttatttatccctaatatgttatttatttccttccttccttccttccttccttccttccttcctttcttccttccttccttcctttcttccttcctttcttttttttgactgagtcttgccctgtcacccaggctggagtgcagtggcgccatcttggctcactgcaacctccacctcccaggttcaagcaatcttctcccctcagcctcctgagtagctgggattacaggtgtgtaccaccaagcccagctaatttttttgtatttttagtagagatggggtttcaccattttggccaggctggtcttgaactcttgacctcaagtgatctgcccaccttggccactcaaaatgctgggattacaggtgtgagccgccgtgcctggcctatccctaatatgttctatctgtaaaatgggaatatgattttatttcctgaaaatcagtgactgaacaaagaaaaaagaacaaagagaagatagaacaaagagtttttactccacaaggaattgtgcatgtggaaatgtattatcttctttttgcttttccccaaagctcctctgaaatgagaggaaagcggatgttttaaagacagaaacctaaaagggtaagtacaataggagataagatatcagcaacacaatttggaaactggaaagcagtaaatgacctaggaaacctaagaaatgtaatttctaaactggcagggaggaaagctgagaaccaatctgatccacccagaagcaccctgaaaagcttaggactggtgctaatagtaaaccctgaaaattggggtgaggacagggctaaaagcagaaggattaggtgaacttctgtgtacaaagcatttggaatccagtacacctccctcaccatgtgcagcatttggctgtcctgcccacactcaagcaacaactggggattagtctatggagaggataaggcaaggaatttcaggaccagagaacaccgggcacagctgagatcagaagtactgtgtgaaaacttggggattaaataaacatttatagacaaaatttgagatgctgcatctcccagatttcttcctccactcagctcctgtagcaatggcagtctgacttgtgacctccaggcaggttattggatagtccttctctgtagatgtttacattaaatgttccccaagggaataggacagtcatgtcaccacattaccatgttacccacactcggcaaaacccaactaactcccatagagttttcagtcagtttttcaatacatcatatttaaggatgaacagataaaccaaataaagtaattttctgagaaaatcctccagactgaaagatggaggccaaaaaaaacaaaacaaacatacaattaaaaatggaatgtgggaggacaaactgaatttgtaaggagaagataattttaaagaataaaatttcactgtgatgctagtttctctcgctgtgcagaagctgtttagtttaattagatcccatttgtaaattttggcttttgttgcaattgcttttggtgttttcattatgaaatctttgcccatgcctatgtcctgaatggtattgcctaggttttcttctagggtttttatggttttgggtttcacatttaagtctttaatccaatttgagttaatttttgtataaggtgtaaggaaggggtccagtttttgttttctgcatatggctggccaattttcccagcaccatttattaagtagggaatcctttccccattgcttctttttgtcaggtttgtcgaagatcagatggttgtagatgtgtggtgttatttctgagggctctgttctgttccattggtctatatatctgttttggtacaagtaccatgatgttttgattactgtagacttgcagtatagtttgacgtcaggtagcgtgatgcctccagctttgttctttttgcttaggattgtcttggctatatggtctcctttttggttccatatgaaatttaaagtagttttttttctaattccatgaagaaagtcaatggtaacttgatgggaataacattgaatctgtaaattactttgggcagtatggccattttcacgatattgattcttcctatccatgagtgtggaatgtttttccatttgtttgtgtcctctcttatttccttgagcagtgttttgtagttctccttaaagaggtccttcacatccctcgtaagttgtattcctagttattttattgtctttgtagcaattgtgaatgggagtcactcattatgtggctctctgtttgtctattatttgtgtataggaatgcttgtgatgtttgcacattgatttttgtatcctgagactctactgaagttgcttatcagcataaggagattttgggctaagaccatggggttttctaaatatacaatcatgtcatctccaaacagagacaatttggcttcctctcttcctatttgaatacttttatttctttctcttgcctgattgacctggtcagaacttccaacactatgttgaataggagtggtgaggtgagagagggcatctttgtcttctgccggttttcaaagggagtgcttccaacttttgcccattcagcatgatattggctgtgggtttttcataaatagctcttattattttgagacacattccatcaatacctagcttattgagagtttttagcatgaaaggctgttgaattttgttgaaggccttttctgcatctattgggataatcatgtgttttttgtcattggttctgtttgtttatgtaatggattatgtttattgatttgcttatgttgaaccagccttgcatcccagggatgaagccaacttgatcgtggtggataagctttttgatgtgctgctggattcagtttgccagtattttattgaggcttttcgcatcaatgttcatcagggatattggcctgaaattttcttttttttgttgttgtgtctctgccagattttggtatcaggatgatgctggcttcataaaatgagttagggaggagtcctgatttttctattgtttggaatagtttcagaaggaatggtaccagctcctgtttgtacctctggtggaattcggctgtgaatctgtctggtcctgggctttttttggttagtaagctattaattactgccttaatttcagaacttgttattggtctattcagggattcgacttcttcctcgtttagtcttgggtgggtgtacgtgtccaggaatttatccatttcttctaggttttctagtttatttgtgtagaggtgtttatagtattccctgatgatagtttgtatttctgtgggatcagtggtgatatcccctttatcatttcttattgtgtctatttgattcttctctcttttcttattaatctggctagtggtctatctattttgttaacctttccaaaaaaccagctcctggattcattgattttttgaaggtttttttgtgtctctatgtccttcagttctgctctgatcttagttatttcttgtcttctgctagcttttgaatgtgtttgctcttgcttctctagttcttttaattatgaggttagggtgccgattttagatctttctcgctttctcctgtgggcatttagtgccataaatttccctctaaacactgctttagctatgtcccagagattctggtacattgtgtctttgttctcattggtttcaaataacttatttatttctgccttaattttgttatttacccagtagtcattcagaagcaggttgttcagtttccatgtagttgtgcagttttgagtgagtttcttaatcctgagttctaatttgcttgcactgtggtctgagaggctgtttgttatgatttccattcttttgcatttgctgaggagtgttttacttccaattatgtggtcaattttagaataagtgctatgtggtgctgagaagaatgtatattctgttgatttggggtggagagttctgtagatgtctattaggtctgcttggtccagagatgagttcaagtcctgaatatccttgttaattttctgtcttgttgatctgtctaatattgacagtgggatgctaaagtctcccactattatcatgtgggagtctaagtctctttgtaggtctctatgaacttgctttacgaatctgggtgctcctgtattgggtgcatatatatttaggatagttagctcttcttattgcattggtccctttaccattatgtaatgcccttctttgtcttttttcatctttgttggtataaaatctgttttatcagagactaggattgcaacccctgctttttttgcttcccatttgcttggtaaatatctctccatccctttattttgagcgtatgtgtgtctttgcaggtgagatgggtctcctgaatacagcacactgatgggtttgactctttattcaatttcccagtctgtgtcttttaattggggcatttagcccatttatatttaagtttaatgttgttatgtgtgaatttgatcatgtcattatgatgctagctggttattttgcccattagttaatgcagtttcttcatagttttgttggtctttacatgtttttgcagtggctggtactggcttttcctttccatatttactgcttccttcaggagctcttctatggcaggcctggtggtgacaaaatccctcaaccttttcctgtctgtaaaggattttatttctccttcacttatgaagcttagtttggctgcatatgaaattctttgttgaaaattcttttctttaagaatgttcaatattggcccccactctcttctggcttgtaaggtttctgaagagagatccacgttagtctgatgagctttcctttgtgggtaaccaaatctttctctctggctgcacttaacattttttccttcatttcaaccttggtgaatctgatgattatgtgtcttgaggttgctcttcttgaggagtatctttgtgctgttctctgtatttcctgaatttgaatgctggcctgtcttgctaggttggggaagttctcctggataatatcctgaagtgtgttttccaacttggttccattctccccatcaccttcaggtacgccagtcaaatgtagctttgatcttttcacatagctccatatttcttgggggctttgttcatttcttttctttattttttctctaatcttgtcttcatgctttatttcattaagttgatcttcaatctctgatatcctttcttccacttcatcaatttggctattgatatttgtgtatacttcatgaagttctcatgctgtgtttttcagctccatcaggtcatttattttcttctctaaactggttattctagtgagcagttcctataaccttttatcaaggttcttagcttccttgcactgggttagtacatgctcctttagctcagaggagtttgttatttcccaccttttgaagcctacttctgtcaattcatcgaactcattctctgtccagctttgttctcttgctggcgaggagttgtgattctttggaggagaagaggtgttctggtttttggacttttcagcctttttgctgtggtttttcctcatcttcatggatttatctacctttggtctttgatgttcatgccctttgtatggggtttttgcatgggcatcctttttgctgatgttgatgctattgctttctgtttgttaggtttccttctaacactcaggtcccttttctgcaggtctgctggagtttgctagaggtccactctagaccctgtttgcctgggtatcaccagtggagtctgcagaacagcaaagattgctgcctgcttcttcttctggaagcttcatcccagtgaggcacccaccagatgccagctggagctctcctgtatgaggtgtctgttgacccctgctgggaggtgtctcccagtcaggaggcacaggggtcggggacccacttgaggaagcagtctgtcccttagcagagctcgagcactgtgctgggagatctgctctcttcagagccgacaggcaggaatgtttaagtctgctgaagctgcgcccacacctgccccttccaccaggttctctgtctgagggagatgggaattttatctataagcccctgactggggctgctgcctttctttcagagatgccttgcccagagaggaggaatctagagaggcagtctggctatagtggctttgccatgctctagtgggttctgcacccagttcaaatttctaggcagctttgtttacactgtgagtggaaaactgcctactaaagcctcagtaatggcagactcccctcccaccaccaagctggagtgtcccaggtcaatccagactgttgtgctggccgtgagaatttcaagccagtagatgttagcttgttgggccccgtgggggtgggatccactgagcaagactgctcggatccctggcttcagccccctttccaggggagtgaatggttctgtctcactgctgttccaggcaccactggggtacaaaaaaagaactcctgcagctagctttgtgtctgcccaaacagctgcccaattttgtgccagaaacccagggccctggtggtgtagggacctgaggaaatccccttgtctgcgagttgcaaaggctgtgggaagagcgtagtatctgggccagatagcactgtccctcatggcacattccctcacggcttcccttggctaggggagggagttccccaaccccttgcacttcctgagtgaggtgatgccccaccctgcttctactcgccctccgtgggctgcacccactgtctaaccagtcccaatgaaatgaaccaggtacctcagttggaaatgcagaaatcaacccacttcttcactggtctcactgggagctgcagactggaactgttcctacttggccatcttgcctggtgatccaaaatcatcttttcaacaaaactatttcttctctcagctgtactttgtcaacatgttaaaaatacccttggtaatttacctgtgcattgataactaactatgacggttctcagtctttgttgcttattagaatcacctgggcaatttaaaaaatatgcattgctcagaacacacccccaacacgttaaatcagaatttatgtgggtggaatacaggcctcagtagtttgtaaagcttcccaggtggttcaaatgtgcatcctgtactgagaaccagtgaactagagttttattactcaaactgtggtccatggactggaagaatcagtatcactcagaaacgtgtcagaagtacaaaatcttaggcctcattccaaacctagaaaataagaatctgcatttaaacaacatttgcaggtgatctacatgcatgttaaaggttgagaagcgttattttagagtgctcaaatgaatcattggggttaataagatcaaggtcatgagtgttacctttgttccaacctccgttttgctgtgtttgaggcagacagtcatgagcatttgtgtttaacggtttctgattttaaggccatgggtgtggatagtcttttgtgtccaaggtagatgcatgtttgtaatgatctcccaaaggcaagggatgattctgtttcttgttaggagttcctcattaccccaggaaatcagttcattaataatattgattactctgccaccatttatgaacctcattccacaagacccttcacaatcagattctacttacttcagtcacattgccgcaaaatcccatggtctttcacaaatctgtgttgattcatgttacacagtgctgggcacaaagagagccctcaataaatattagctagctattattacttctgccttgaaatgggaaaacatctcagctggagcatctttttccctccttcctcacctggaaaatgcaaatttagcattcaaaaactgaccctgcgtagctcgccctaagtgccctcaggtgagggtccatcctgtatgccacctcctgtgattagaattaatctgctgtgggtgctgtagcccttcctactctgggcgctccttcagaagagggaccagatgtccttgaacatctaggactcctaagccctccttaaatatgtatataatggatcaataattgaaaccaaaaatcatctccccgcatggagatttgccatgtacatggcagagtttctactcaggcaaaatagaaaaccactagaaaacatctggttttgaaaatgatggagttatgagatgcattttttatgaggcagttacggtttaaaggaaaaattttaaataatgcattctgtaaattcctgaactatagtctttacttcatctatatggcttccaaggaaaattccatattaaaagaattggacttttattgttttatgcattaatttattcactcacttattactcaacagtaaatcactttaaatatctattctaaagaattatatgttttaaatgcctacaatagggcatgaaaatatgaaagtatcaccccctagcaggattaagtggaaatatcatggtatgataataacttacaaagagagatagtgtatattttgcaattaggcaaaatattccacatttgctgtggagagcacaaggatccctttttaggggattttgtggcccttcctcattttggtgtgctttcaacaaccagggagcttttcttcaggaggaagatgtcactcgggctactggaactgctttacaatgattgcagatgcggaagtatgaaatcataacttctttgattcagatttggacaactctgaagggtaacttacactccagagtttactcctgataacatgttgaagctatcctctgtgagactggatctaaaatggtactttgacttgtcattttatcttttcctttttgcttctctcattcccagtagaaggtcccccagtctcccaggaatatctttactaaatccgttgcatgtcagtcctcttctcagggtctctttctgagaatcacgacttaaggcactttttaatgctatatttctacatagatatataaatacacatacatagagttttacacactcagcattctttaatactttttttattttgcatttgtcaattagtcatttatgtttttatatatctgtattttccattgggttaaagggtccttatgaatgggaactgatttattcccattgtgcccctgttctctgccctctccctaatccaatacctcatagactcccatacagagtaagtgctcaaagatgttgtttgtgttttttcaaataggatagaatacacattcattttatacacatatgcattaattaagaaagtcaaatgtgatatctgaagaactgtaaccacatgttattaaaggttcttttttctgggcaggcagagcatatatttagcagtgttatgcttaaaaataaccaagtgaaattttctttgaaatgaatttatcattaaaagtagtttaatgtaagaaatggtgaaaataattataccactacaaattctgtcttttggactattttgtgattaatgcctactaaaattattcaaatgtaatctgacagatttttcaaaaagccataattagaaatgaaaaaggagataagaagtttcatcaaatctcttttctttgccatcaaaactagtcttacccagtttcctttcatgaattctgttcccctaacatattttcagttcagccacatttgggatacagacatgcaaaactctcacagcacgcaaatgagattagcaacctggttgccgagcaaaatgcaccttttctctatcgcctagcagggacatccccctggacaggaaaagtggcctttcctgagtatgtctgctttaactccattacctacaatgccttgggatattcttcccatcaagcacttggacaatgaatttcagaagtcatcctatcagattaaattgatctctaccttcaaccaattcccatgcaaattaggcttccataaacatgtagcatgaccaaaagaaaaagctgttgcagaaattctaaagaacctaaagtatttttttcatcacttgtcacacgtgttaaagaaaagtcatttttccatgagcttccccatgcctgagttgctgcctcatgccagctctttataaaagttcacaattgtttcaatgtggttgttgctattttcactgtatagttcttcattcatcgtcatggttggcccttaatacaaaggtacgagaaagtattaccggaggatagcatgctactagcatcagggtatgtagacagaaatgtgactttctaagataaggccaaaaaatgatggtgcctttgtgcaagagaaaagtgtttttctgtttctttcaataattacctatatcacaatcacttgggagggcttgttaaaaacaaaattctcaggatccattctttgaatccaaatttctagagataagaccattccatttatcaagctccacttgaccatcactgattgccccaggagtaagcctatgactcaaacagagctaatgagagttcttccttagaattttaaatttatggccactggactgggtgctacgtgaggatctggaactttgttttgctctctgatatatctctatccccttgaataatgatggttacatagcaggagcttattaaattgaattagtggagtaagtctcagtttccctttgatggacaacattgtgaattgtgaggcagccatattcccctatgcttagaggaatacaaacagaatgagactgttctaacaacactcaagttcctaattccagttgtcttttctgcctagctatttccctgtcattcccctggctttatgagccaatgaattgtccaaatttgcttaatttgaatttcaaactaaagcagtttaataaacatagctaagatcttataatctcttattttttaattattttattatatttttaccacacttgagcttacaaccaacttctaaaatagatttaaaatctgagatgctaaaaagtagagaagacttgcctcaggtcacatgctagtgtatggaaaaaccggaaataaattttttattaaatcttccttcttggtggaaaaggataagtaaaacttggaggagattgagaactttgaggtgtttttacctgtaatgctttccaattagcttagcattatagcaaaactggttcagtgatgatggagggtttcagccactgggcacttgcagaaatctcattgtactaaagacagattatctgatacattgttgtctaccccaaataaatgtattatctgtcaatggaaagtaagagtaaggggaatcactgatgttaacttaatattaaccacaaggaaaaagtgggtagtgatggtggtaattcagaagtgttaggaataggaagagtagtacattgttgtcatacacattgtctgacatagatcctggatatgtctgggctcatatttgggaagcagttatttcataattctcacagacaggaataaaccctttgacagttgcttcataagtgtgggggtgaaacactcaaacaagctgggaagattttgcttgcccagcagcccacagcctttgctttggcatcaacaccctaaattttcattggggaatcacttctttcccactctcataacatgttcccaggcataagcatgtgaccaaagtttggccaaccaggttggttctggaatgggcatgtgaccaaaattaggccaaagagagtcaaaatcttgagagaaacactccttttcttcattttatttatttattaaatttaacttttattttaagttcgaggtacatgtgcaggtttgttgtacaggtaaacacatgtcatgcgggtttgttgtacaaattattttgtcacccaggtattaagccttgtacccatcagttatttttcctgatcctctccctcctcccactgtccaccgccccagtgtctgtggttcccctttatgtgtccacagagaaacactctttttctatgaagattgctaaactgtagaaaaagcctgcctcaaaatgaatccaacctggggtgaggagaggacaaggaggaagaggaggcaggagaaagggagaaaaatttcacatcattattttagcacttagtgtaagccatgccaggatctcttggtttcaacccatcagttctcttttggagaaactcagggctagttgagttcctgcctaatacagaggcagctgaagagttcattgaagttgcagagagaatttgctgaaagacaaagatcttaaaaacacaaagatgagatggaggcaactaaccaaatatgaattggaggaatggcatgaagcccaaaaatggcatcagaaaggcagagagagtttaggattattaagtaaacacgcaaaaacaagacacaattcctttcttttattctctgagaaagaagagacaaaaagttacaggagtattggttgttccataagttgatagaaggaaggcaaaactattccatttcttttatcttattttttcattgaagaaaattaatttcaaactgaaaaagttagaacaacgaagatcaggaaaaaagagaaaccctggacacttacaaagatcagaggttatatcagtctgaaaataacttttgctgatttaaacagaaaaggaatttattaaaagaaaattgtgtagctcactgaaactttgggagggctggaaagctgggcagaggctgaggggcaggaatgtcgctctaaatcaccccacataaaagcctattgaggactcagttgccaccatcactatgtaatagatgatacagtttctgtcagaactaccacagcatgggacatttcatgctgccactaagaccctgtctctgcttccctgggaattcgatcttgagacagccaaactttccacccaaggtgaatctccatagtcacagatatttggcatggttagcttcaattcaaagcctgatagtactgacaagagcatctgattggcagaatgttgtcatgtactcacatcctagctgcaaggaatgttgtgaaaaatctgaatgtggcattttcaattatgtaaaaggaagtgaggtctgacctccactaaatctcatgaagtgagaattccaagaaataattgtcatgacaaaagtcattaacctttccctctatgttttcttctaggagttttagcatttcaggtctcacgtttaagtctttattctatcttgagtttatttttgtatatggtgcaagacaaggatctgatcattcttttgcatgtggctatacagtattcctaccaccttaattgaagagagtatccttttcacattgtttattcttcatagttgaccatatatgggcaggtttatttctggatttctagtctgtttcattgatttatatgtccgtctttatgccagtaccatactgtttttttattactgtggctttgtaatatatttttaaattaggaaacatgaagcctttaggcagggtgcaggtgtaccattgtgctggcggggaagggaaggctaggtctgcctgggcatatacgcaccagcatagcaatgtggagggtggccatcagtgcaaacgagctgttgtgtatttgtagagaccactctgctggagcactctgccagtcaggtgtggtccaacaacagctatgaggtgggccccaagtggcacctggcagctgtgctgcaagcagttgtggccaggctggggccccacaagaggccagcagactgagaggtgctcaggttggactagatctgtctcatgggtaagactgccctgtagagttcaggtctgaaaggtcccctagggttaagtctcctatgggagcaaatctagcctagggggatgcacatctctgactgttctccactacagttgcttccacaggacaacctctgttctctgcccctggctggagttctgcccctactacttctctaagtaactttccctgccaactcaagtgtccgtggtggtcgaggggtgtcctcctgctgagatttcaaaggcccacaatgagagtgtgttgctccttgcctgttaaactcaccccctctgtcggagtcattgggggccaggaacacgttccagtgcgcaataaccctgggaagtgttcctagcttcctcccacttcagcccagcctccacgttttccctccgtctgctctgcttacaactacaggataagaacatggcagcactgggatatgaactcatttctgcttatctccaaaggccttgctcattcatgcagactctcagaaatgaaaaataattcccttcatctttgttaaatcacatgttcctacagacaaattctccaaagcttttatgaaacctatgtgatgctgtaataccattgattactacagtatttatgaaatataccattcatagctttaggctacacaggcacagctacatatcaagctctcttgaattctctctctttctaaaacctatgaatttgaagtcaggatattttcagaagtccaactggtgttaaaaatccaaatagatcaaacatcgtttctgtttatatctgtgtgacaactaataccaatgggtgtaattacaatgtggaaaaacccacataatttctgaggaaagtttatttcactggaagtagccgttaccaataagcaatagaaaccctaaccagtggctcttattttgcaattacactttttcatcttaattttagtatatgtgcagccaaagcaaacaccactttttcatgttaagcaatggctaagactgtgtgtgatataggtgaaggctatcaccagataaacaccatcaaaaagttattttttatagtgtctttgggttttgattttttagtatccttcttcctttccaactccatcctcctcttccacaaatataggtttagtattaattctaaactaaatgatgcctgaggcattaggcactacaataagtaatcctttaagtcccaccagaatttgagtttgatgatatggtgtccattgtgtagatgaggatacatcctccgtgaagtgcaaggtcacataaccaaatgtgaaaaagtaggtctgtctcttgctgaaaggaactgaacattggatgctgctgcatgaagcccaaggcttcagtggacaacctcagaaaccagtaactctgagccatatggcatgatattggcctcccagaagtctgaataatatgtatggggatttcccagattttgaaggcattaatgactcatttctctaggataccgatgtaagttcttcagtggaagaaaactggaaaatgagtgtctttgtctacagacataaggtcttaataaaagtaatcatgaaattgaccttggtggggagagcaatgaaacaggattacatggcctgagtgaagtcctaacaatacaaaagattaggtacaaagacacaaagataagaaaaggaatattgactggagtctggaatgcaggagcatgtgtgtgtatgtgtgtgcatgtgtgtgtgagtgtttatgtacctagataagtttagcctggagaattaacaagccatgcttgtgttttacaaaaatacactcaagaagagacatgggttggaaattattgcagaaatacaataagagatagtggtgacatgaacctaagtttatgatgatgaatttgaagagaaattataggccttggcttagaaagcaacataaaaaaagacttggttcttcaggaacacaatgtccacagaaaaacttcactagaaatagaatttgcacatagacagatgtatatctcactgcttacttggatgaaatatatgcatatatgcccatttacagatggactctttcatctctgaaagaaaaagtgcacttcagatctacactacagatatatttacctacaaatttacctataccagacagttttacctgctatgttttaaaagtaaagcagttgcttaatttattactttaaacttatgagtgcattttaaattgctaagaatgaaatgaaaattatttgaacttggacagatatgtaaggatacttgatgttgcttggtagcttttctcatacagatctattttgcacatgagatttgccagggagttgaagctacctcctattctgcacctgtttatatgatttggtaatagtcttttgtagtgaaggtttatgaacatggtgaaatgcatacattcaattgagatgataaaatggcataactcaagtttcaactatgattttgataaatagttttcaaaccagttttgggggtttgatgtaatcccaaaggggaagataacaattttactattaaaaattgttaacattaatttggctatagactccaatttttggttaacaaaataattgtcataattatttcattacaatttcaatataaatagagttataagttctcgttttactcagcacattttggtgtttttgttgttgttgttgtttgtttgtttgttttttgcgagggggtcttgctctgttgcccagactggagtgcagtggcatgatcatggctcactgcagtcttaacctcctgagctgaagcaatcctcccacctcagccctctgggtagatgggactacaggtgcgcaccaccatgcctggctgatttttgtattttttgtagagaccaggtttcaccatgttgcccaggctggtcttgaacccctgggctcaagcaatccatccacctgggcctcccaaagtggggagggattacaggcatgagccaatgtgcccaactccatttctgtttttaagaataattcttttatttctggttttatgtatttttacaaataattgacatgataatgtaatattcacaatgcttcaaaaatgtgaaaaagtatatgtgaatattaatcacataattgataaaatatatgaaataatgaagccaaagcaggtcattaagaaatatttataaacattaggtattgaatttacagatgttgccaaagttgtacatctacagggccagtcatcataaattctgattgatgtttaaaatgagagcaagaaatacccaattaagtagtaaattgaaaaccatctaatcttcttccgatacgtctgtgacgtcttctttctacttgtaaagtctcattgcacgttgaacaggagtcttaacagagtcataagtccatcccttcctggcacacagcctttcaatgatgccaggcatttcatagcccttgcttagaatgaaatccttaaaggcaattggtccataaagatcgtcaagaatatcgggttcatctggcttttcaagtaagagcttggggtcaatcaaaggttgatcacttcttagctttttccccagcttaggcttaaggtaccatactccatacctcatcttcacacactgtgcagtgtaagaattcggtgccatctggagtttcctgtcccagtctttttcctgtgaggattcgacctcatccatttcatctagctttattctgtattgcagctctgagacccattcttttatcttcttaatctgttggtcttcataggttgctctccacttgggggtaaagtcaaacagattcctgatggattcttcatcaactcccatgtctcgagcccacttgaagtcatgcatttttctcgatgtgtatctatgttgaagagagtcagaaacacattctgttgtgcttggtgtatcttcctgaagcagttcttttagacaggacgctcgaatcttgggaggctccaagaagtgatgggacactggagctttgggaggctctggggagagatgggacactctagtcttgggaggctccgggcggagactggacacctgacgagtcttgggaggctcagggcaaagatgggatgcctgagtctctggaagccgtaggcagaattccctacaagactatttaccaggcttggtgggttccttgattgtcttctcccggccctcacaataagcccatgccttctccagcttcctctcaggatccagcagtttcagcatctgtagtaggagactggacacccaactagtgttgggaggttgggaggttctgggcggagatggaacactacagtcttgggaggttccgggcagagactggacacctgcatcttggggggctccgggcggagactggacacccgatgagtctcgggaggctccgggcagagatgggacactccagtctcgggaggctctgggcagagactggacacccgagtcttgggaggctctgggcagagatgagacactccagtctcaggaggccccaggcggagactggacaccagagtcttgggaggctgtgggcagagatgagacactccagtcttgggaggccccgggcagagactggacactggagtcttgggaggctgcaggcagagatgagacactccagtctcaggaggccccaggtggagattggacaccagagtcttgggaggctctgggcagagatgggacattccagtctcgggaggctccaggtggagactgtacatccgagtcttgggaggctctgggtggagatgggatactccagtctcaggaggctctgggtggagactggtcacctgagtcttgggaggctctgggcagagatgagacactccagtcttgggaggcccagggcagagactggacactggagtcttgggaggctccaggcagagatgggacacctgagactcgggaggcctcgtgcagaattccccacaagggtatttaccaggctcagtgggttccttggttgtcttctcctggccctcacaatgaacccattcgtcctccagcttcctctcaggattcagcagtttcagcacctgtagtaggagactggacactcgatgagtattgggaggttccgggtggagatgggacactccaatctcaggaggctctgggcagacactggacacctccgtcttggggggctccgggtggaggctggacacctgcatcttggggggctctgggcggagactgtacacccgacgagtcttgggaggctctgggcagagactggacacccaaagaatcttgggaggctccgggtggagagtggacacccgttgagtcttgggaggcttggggcagagatgagacactgcagtcttggtaggctccgggcagagactggacacccgacgattcttgggaggctccgggcggacactggacagccgaccagtcttgggaggctccgggcagagtctggacacccgacgagtcttgggaggctccaggcggagatgagacactgcagtcttgggaggctctgggcagagactggacacccgacgagtcttgggaggctccgggagaacactggacaccccacgagtcttgggagactccaggcggagatgagacactccagtcttggaaggctccgggtggagactggacatccgacgagtcttgggaggctccgggcagagactggacacctgaagagtcttgggaggctccgggcagagatgagatacgcgagtcccgggaggctccgggcagagatgggacactccagtctcgagaggctccgggcggagaccggacacccgacgagtcttggcaggctctgcgcggagatgggacactccagtctcggggggctccgggcagaggctggagacccaatgagtcttgggaggctctgggcagagataggacactccagtctcaggaggctctgggtgagactggacaccggagtcttgggaggctccgggtggagatggaacacctgagtctcaggaggcctcgggcagaattccccacaggggtatttaccaggctcggtgggtgccttggttgtcttcttccagccctcacgagcccatgcgtcctccagctgcctctcaggatccagcggtttcagcacctgtagtaggagatctggaggcatatcttctcccagattggggtacatggccaagggatgcttggccatcagctgggcttcctctacaaatgccttccatgctggctgggctggcaagagcttggaaaacagggccactttcttgagcagctttttctgcctgcttttcgggtcagcttggggacctctgtgagagattttggggagtaagaactcgttaagtctacaaatgagcatatcttcgggagacggacagccatagtggaagctgtccatgctctcctttacaaatacccagttctaaatttacaagaaaaaaatcaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaacaagttcaaccattgtggaagacagtgtggcgattcctcagggatatagaactagaaataccatttgacccagccatcccattactgggcatatacccaaaggattataaatcatgctgctataaggacacatgcacatgtatgtttattccagcactattcacaatagcaaagacttggaaccaactcaaatatccatcaatgatagactggattaagaaaatgtggcacatatacaccatggaatactatacagccataaaaaaggatgagttcatgtcctttgtagggacatggatgaagctggaaaccatcattctgagcaaactatcagaaggacagaaaaccaaacactgcatgttctcactcacaggtgggaattaaacagtgagaacacttggacacaggaaggggaacatcacacacgggggcctgttgtggggttgggggagggatagcattaggagatatacctaatgtaaatgacgagttaacaggtgcagcacaccaacatggcacatgtatacatatgtaacaaacctgcacgttgtgcacatgtaccctagaacttaaagtataataataacaataataataataataataaaaaccaaatactcagttctgggtgtccattggcgggaacctcaggcgcctgtgcttacgcttcgcgatgtacttggaaggcggtttgtcacagtaccagggcttgcagtccatgcccggggacctcggccggtcccgcggcctctggtcccccatggtggccctcgctggggtgccatctctccagttcccgcggttcctgatccctgccactctagtcgctaggagaccgcgagccacgcgcagcccaggttcttcctcgaagaggggcagcggagacgccatctgcgcagcctggattctccagggtatggtcagcaacggagtgcccaagcccctgctcattccatggtgtgtggtccatgggatggacagagcgcagtttctttttccattcgcctttggatggacatttcggttgtttcccgttttggactatgacaaatattctatgaacatttgtgtccatgtcttcgtacgtacatatactttcatttctcctggataaattttagctaggagtccaatggcgggatcatatcataggtgtatgtttaacgtttttaagaaacgaccaaacttttacaaagtatttacactatttcatattccttctactagtgtaggagcattgcagttttttcacctatgatccaacacttggtatggttagtcattttaattttggccattctaataggtgtttagtggaatctcattgtggtgtttatttgcatttcataatgactactggaattgaacatctgtatatttgcttatttgcaatctttatctttccttgggtgaagtttctgtacaatttcttttccatttttaaattgtgttgctggatatcatatttcgttttgagaatccttgctgtgttctagatgtaagtccattatcacatatatgatttgcaaatttttcgcttcatccttggcttttccctttcactgtcttaacagtgataaagagaagttttttaatttgatgaagtccaacttatcaatttgattttttacggattgtgcttcttttgatgtatctgtgaaaactttgcccgcccaaagttcacaaagattttttttatttaaatctgtttaattttttgtaaacagcacacgatatagatcaaagtttttatttgaaaaaacgtgtctattgcctatgtacatacgatacatttcagaactatttttgtaaagactatcttttgtccactgaattacctttggaaatttgtagaatataagttgtctatattttttatgggtcaatttctgggcactcttttccagatttttctctcacacaaatttcgcactctgttgattactttagctttgtaataaatctagaaattagtctgtattagtcctttaacaacattcttttacaaagttggttcttctaggtcctttgaatttctataaaaattttaaaatcagtctgtcaatgtctaaaaaaatcctgttgggattttgattaggatttggttgaatccatagatcaatttgaggataattgacatattaaaaataggaagtcttctgaccactgaaaaaggtacatttttccatttgtttatgttatttttaattttctcaggaatattttgtattttttagtgtatacaactttcacatttttttctctccagagttttcctaaatattgtttttgatactgttattgttatttaaattgcaattcccaattttttgttattagtatatacaaatattgatttttgtatatctatcttgtatcatacaaccttggtaaactcacttattactttcaggagcacttttgtagatttcattgaattttctttatatatgataatgtcatctgtgaataaagacagtttctcttctttctttcaaaattgaatatctttatccccctccagtccagttggaatccttggttttcctttgaatcatatcagttaaattcttatctctcttgtgatgtttaaaacgatacctacgaaaaagctttcttttaaaaaaattatagacaaattcagcttgcattattcctttaccatattttctcagcacataataatttttttccatacattcttatccatttttaaaaagttttcttatttcccttgttaggtgcagctgaacaatattttctaccattactagcaggtataccctagttcctccttgtaaatgaggcatgatcaatgcctttcttgcctttggctcgtcctctgtaaaataggcacaatgtatattcctcttaggtttctcattaaatccaagaaatggattatgtgtaaatcaagataatctatataacatgattttgtatagtatctggcacagaataagcatccagtaaagtactgttattttatataggattactacaatttgaaaataaaatattctacattcaatgtctaaataaaggagaagcagaaatcatacagatctatttacttgtcacaaatattttcatttatcagttataagaatctgttaaactctcaacatatttggtagattttacaatgcatagttggtaagaccattttgatatggatttatttttaactttcttacttggaaaaattccatggactgtatgttaaattcaagagccaatgcttcaacaattctctataacagtactctaactagcaagctcatatgagtattcacttatctaaaatgggtgagggtttgaataaaacttctatattttaaataatcccagagaaaaacacacactgaagctcctaaagggcaactgggcatcttcaaaatttttcatgtgactgttcattaaaacagtttttgtaccttacagccacttcatttttttcacttttcaaagtagaatattatacaaaagactcatatccagaatatataaataattattaaaatgtaacaatgagacaacagagaacacaaaacaaaaatgtataatacatagtagtttaacatgtatagagataaatagctaaagaaataattatagttgtgtgtacatattggttagtatacatgcatatattttatagttctgtctgctgagaaactcgaaaaaaatatcacctaagtagccaaaagtacatccagtgtccagatcttggtttctaaataccattctccaaaataacaaaaacaaaacagagatatccttggagaaatgagtaattctaggctgggggcagtgaaaacacaagatgagcctggagtattatgtaatgccagaaaataggaagttctcagaaaacaaaagaataagagcagatcaggagccaaactaaaagagcattcaatggccaaagttaaaacaatttaagcaacatgagaattaaactttaaaaattataacacaatataaaataaaatatccatgagtccatactgatacaaataattgtacaaataaataaatgacaaaaaggtgcaactctgtcttagaagaatttcaaaaaatgtacatagatacttctccccccaggaggtggaatttaaatgccctccccagagtgtgggctggattctaaaaaattgaatatggaaagggaaaaatagtaacattttagtggagaagcctggcagtcctctccttaaccaagtgatcaatgttaatatcagcagtgagaagtcacgttggtatcatgcactcctctgataggatgtgctgagaaagactccacctctgtagtattctttcctaaaatccagaatcctagtctaatgaggagaaaacatctaacaaacccaagtccagggacattctacaaaattctcaagtactcctcaaaaccataaaggtcatgggaaacaagcaaagtctgagaaccagtcatagactttagattaaagagacatgaaaactaaattcaatgtggtaggctgggttggatcctggtgctgaaaagggacatgggtataaaaaatctacaaatctgaataaagtctgaagtttagttaatagtaatatgtcaatgttaattttttagtttaaatacatgtacaatgtaagatattaattttaggggaagctgagcaaaatgtgcatgaaaatgctttgtacagtgtttgcaactggttcataaatcaaaaattattctgaaataaagggtttccattttaaactacatattgcatcatgacaaattatcagcaaatcactattaatcatacaagagagaaaggtgtagcgtctttaaaatgcatacttgtggcccctctctccttatatatagtaaaacataattttttcgaagtggagccagtcatctacattttacatggtctctagattatacacaccaatatgtgagaattacttttctaaagccctgtgccttttataggccccaaagactttcaaagatttaaaaaaccacagtagttatggtattatccaaagtcacaaaatttggagaaaattaaatttcagcaagtgctatatgggaatgtaaaaatcagacagtggagcctgtggacaaaataattcacttagatacacgtacataactggtggacccacaggataatgaagtcatgatagaagagtaaagaagatacaaagtttggtgagtacctgactggcagtgaaaaaaaactaggagtgaaagcaacttacttgtgcaaacagcccttcttgggttaaagaaaactgacatcactatagagttcagagaaattacaactggcctgttcagtcaacaagcaacaactgccttagtatgaagtgttactccagaaatgaataatgtagcttgcaagcaaaaccaacatcaacaagctaataagtaatgttcaaggaagtcaaaatgctctgagcagagtagcatgtaatgactaagtatataagaaaattaaaataaacaatgaaaatcaatgtgatgaagtgcattgatttaatggagtcaaaataatcccagttctgacatcttcgtgtgcctctgactgctcttagttacctacaacctttactgcagacttaactcaggacaccattttcatgctccagcagactcatgttatcttcaaccttgctgcctcttccacccacatgcggcacctgccagcctttctcagatactcaatcattttcattctgatccaacccacttcagaattattttgcttttattagctcttggtaagtttactttctgtgatgattaattttctgtgtcaacttggctagactaaggtgcccaattatttggtcaaacagtctagatgttgctgtggaggtattttttagatgtgatttaacattttataccagtagactttgaataaatcagatttaccctccataggatgggtgagcatcatccagtcagttgaaggcctttaggaaaaagacaaaagatccccccaaaagacggaattctccctccagactgaaacacagtaatccgtttgagtttccagccattagaatcaagactgcaacatcaacttttgcctgaatttctaacccgcaaccagctctgcagactttggatttgccaacccccacagttgcataaaccaattccctaaaatttctctatctatctacctacctatctacaaacatatatgtatctatcctattatttctatatatataaatcttatatcctattatcctatataaccccctctctctcatatatacacacacacacacacacacacacacacacacacatatacacacacacatacattttctcatctttctagagaaccttgattaatacactattcgttttgatcatttttctaccagtaacaatgttcatatcttgtcttatgatgagatacactgcagcgattttaccactgctacacccactgagaatttttctcagcaaggtataaaatatagttaaggaataagaaataatacagacttaaagatttccattttgctttttgaatcaaaaagcatagaagaattattccacacattggctgaatatcagaatcacttgtggcccatcttaaaagtatatatgccaaggttctaccccgagcctgcagaatcaaaattcctcccattgataatgattcacagtcaagggctgaaatccctggatacatagtaatttgatcacagtatctcagataggatatagtccagcactaccgttattaataaagaatttgaggcaaaaagagaacaaatgacttacacaagttctcaaaaggtaagaatgaacagtgtcaggttaatatttttcatatttctagaagattcatcctattttctggtatagataaattccagaaaaatatgacagtattcctgtctccttgtatgcacatttgtcatctggtccattgttccaattcacaaatataaatatattgcaatatttagaaaataattgagcagtggcagctctattttataaggaggttcaggtacaaatgacactctctagtatacagttagaggacttcacaaatggctaaaatcttggcaattttgtgtgttgttaaagtaataaaactttgaggacaggtaaatgttactgtgtcatatcctctgatttaattaaaaaagactgctctcactttcctattgacagaattttgtagatgcatttaacaaattgtcattattcgtagcttattttctagtagcaagcaaaataattccagaatcacttcatatcacggatatgaataatgtagaataaccaataatctcagttgtccatgagtgctgatttaatcttattccttggcttctaatgcaaaatttgcatcttttacagaatttccaattcacagagtactgtacacatatacacataaccagctgaaagacatgttctcagctaatgtccaacattggaagagcaggcaaaaatatgcaatattagtattatttacagacagattgttaccattttaacctcgattttgaaatacagattgttggccaggcacacggtgcctcaagcctgtaatcccagcactttgggaggctgaggtgagtggatcacaaggtcaggagttgaagaccagcctggccaagatggtgaaacctcgtctctactaaaaatacaaaaaaaaatttagctgggcattgtggcgggcgcctgtaatcccaggtactcgggaggctgaggcagagaattgcttgaacccgggaggcggaggttgcagtgagccgagatcatgccactgaactctagcctgggtgacagagcaagactccatctgaaaaaacaaaaaaaaaaaaagaagaaaaaagaaaaaaagaaatacaggttgttaattctatgttaaaaccacagctcttaagaataacatatatatacatatatatttatgtatatacacacacatatatattcataccacaattcacataaaggtccaaagtttagctggttttaacattagtgatcaaagcctaatatatataggcaaatgtatgcattcaatacacatgtgaacacaccacagttttctaagatattattgaactttttacaaaatgttaattgggttgtgattttataaaaatagttctaatattatattactatctgtgtgttcatttgacctaacagtactccttacaaagaaaagagtctgaaggatattctgcatcatcccgctgtgaaacagctttatgatgccaagtgtcccatacagagatttactccaatgaactggtttaatttagaatgtgacctaaccaattatatttaatagcatggctaggaaaatcagccccatagtctaaaaaccagtatctctgggaaaaaaatgaagtagacttctggttttgcacaggatattgtgattgctatttccattgctccttttacatttataacaaatgaataagctgaatatgatttttcattttgtagccacaatctctgtagacaaactgatcaactgaaatacttacattgatttggtcaatatatttatcaatgaataatgatttaggaagttattttcatgatttggacaattgtgcacctggattcatttacaaactattgtctttttctaatgttagagatgtttgatgtgaggaagaaaaacttaaggagggagactcacatggaggaaattgcgtttttctctacagcataattcaggaatacattggattagaagtcaaagtgatgatttggaaggaactaaaagcaccgatatttgatagagacctggtgaaccagggaagcaattctaaatagactattttggatgtggaacagatatttccagtcatcactggagtttttagtccttgacagtgatttaaggtcttcggaatgctaagcaatgttacaatacctgcacatacaacacagtcatatgctttgccaccagtagctgctctcagtgttgcaggacttgtccttagttcagctaaagactagctcctcgtccgtcccacagccatgaaaattcaggcttgctgacggtttgaagggtgagcaaagcagagtcttattgggtgaaaagggaaaaagggggaagagggactctccgcaaggccagagttcttgcccgtgcacttcccacctcatgctgtttaaatcccaggttctacacaggaagaggtggggccaggcttctccctgatgcaaagggtgcgaactcctgtgtctccacccagtgtgcaggctggttggtgttttcctgggggacctcctcccacctggctgtcttattcccccctctaaagaagtacatctaactgctgttagaataaggataaggataaggataaggataaggataaggataaggataaggataaggataaggataaggataaggataaggataagaacgaagactgatcttaactgcttcctgctgacaaggggcgctgttttggggaaatggcagccagatcgccctcagagcagaaggagcagagtcagaggctctggttttatgaccgtttggagtttgatggcctgaaggcaagaacagataatctgggttattagaaagcatgtgtcggccaggcgcggtggctcaagcctgtaatcccagcactttgggaggccaaggcaggcggatcacaaggtcaggagttcaagaccagtctggccaacatagtgaaacctcgtctcaactaaaaatacaaaaaattagccgggtatggtggtgtgtgcctgtaatcccagctactcgggagggtgagtcaggaaaatcacgtgaacccgggaggcggaggttgcagtgagccaagattgcgccattgtactccagcctggccaacagtgtgagactcctcctcaaaaaagaaaaaaggaaacatgtatcaaaacgaaacaaggggaagggtaacaacagctcaaaacttataaggcccttttaccagtttgcatggggacggggagaccaaattcccagctggtaaaatacttcacccatttgccagtatgttgggcttctcggttccccctcccctgagcctaaccccaagccaaccagtttaaagtttgggaaattaactctttccagtttggaggatgcatctgagggaagtgctccatagtacagggacacaattacctattagtgaagagaggacagaggaggagagaagaaaaaataagatacttttttttttcaaaggagtcccaggggttcaggatgcattcgaaaggggtacagactgaagatgaatggctacccatctagaaagaggggagcaggcatccctggttcccttctctgcctgacagatacccgaggtacgtgagagagacagggaagagagtcctctttgcctcttctgtccttgcatccccaagtcctgtcaaccttggcagatgtggccatgagtgtaaaagcggcttgcacccatgaagcagggggtcgaacgggtgggaatcatctgctccttcccacgtatgccctatcttccctgctatcggtagccttgaattctctagacctcatttatgccatggatactaatgtggcctttatccatgaaacaggaagcttgggcttggcttaatcggcaggaatcagccacactcacgtgcactgtgccttttaacctctgttgtcgtctgcctctggatcccttagatctagtcttctttcctagggctttgactcaaagcttggaattagtttgggacaaaaatgtatctcatgggggtgttgcatggactccttatcataagctgaatgctaaggtgaaactgtggaactgagtcctcctccaacaagggagagagaaaaggatgtcctgtgacacacccaaacacctggtggctatagttatgcttgctaggatttgggtgcatggtgtttgtctttggttagctggcttgttcttactttcccaaaaggaaacctccgagtaatgagcatcctattgattccaatcccctggcaggatttgcaggataattgctcagaattagaatattgatccagatttttacattatccatccctcttgttctttctgagctggagccagagattgctggttggttcacaggaacaagcagggttagtctaaaaggtaagtgaaaacttaaaaacaactagtgcatttagaatttaatgacaaatgtatgataagttttggaacataatttctctctctccagtcctcatgtttgttaaaaaaacaaatcatcataggactggcggtttttgaaacagaccttagtcttatacttggcctgattatttgcataaagtgcagcaagaatgattctttctacataggtcttttggattggctttgatggagctctattccccaagggatctcaggtaagaccttttaaagctgagcccagccatgggtttaacctcaaatacctgtgagttgggcgatccttgtctcttaaggtcccaagataaacttagaggtcctggatctggtatataattgctcacagtagtctcttataatccttttatttccatggcgtcagttgtaacatcatctcatcgttttctgattttatttatttgtatcttgtgtctttttttttttacttagtctaaaggtttgccaattttcttgatcttttaaaaacaccaaatcttttttcatttattttttctattgtttttattctctattttatgtattcctggtctaatctttgttctttccttctttctgctaactttgagctagtgtttccttctttttctaatctctttaggtgtagagtgagattgtttatttgagatatttcttcatttttaatgcaggcatgtattgttatgaacttatctctgttaactcaagtttatcctaaagctgcctccttatatattttaagttcagcctaaaggtttctctgtatattataaagtataacctaaatggagttgtacacagaccataccctacttttctgctgatcaccaagttttggccaaacctggccaactgttcaaatcatgttcaaataaggcaaactatgagctggaaccaatctgactgtttctatacctcactttggttttctgtatgtcactttcctttcaatgtccataaatcttcttctaccacctggcgtgctggagtctctgagcctactctggctcaggagactgcccaatttgcaaatcgttctttgctcaattaaactcttttaaatttaattcagctatattttttcttttagcatctcttagtattgcttttgctgcatcccataagttttggtatgttgtgtttacatttttataatattttgtatgaaatatcttttctccattctttcactttcagcctatgtggttctttaaatataaagtaggtctcttgtagaaagcatatagttgaatcttgttttgtttaaatattttttattcattaacctattttatagttatagttatttttatactttgttacttctgtcttctaacttccatacaaaaattaaaagtgatttgtgcaccaccaatacagtatgacagtattctgtatttatctatagtcacctgtaccagacagctttatacttttatatgctttcattttgctgtttagcattttttatttcaactttaatgactccgtctagcatttcttgtaaggcaggtatagtgcggatgaactctctcagattttgtttattttggaatgtctttagctctccttcatttttgaagaaatgttttgctaactatagtatttttgttggcaagttttttttttttttttcccattcagcactttgtacatatatcatcctactccttctggtcagcaaggaaatcctctgagtcttattgaggttcactcatgtgggacaaatcgcttttctcttgctttcaaaattctgtatctttggcattgacaatttaattataatgtatcttacatggatttctttggattcaccttttttgggatccattggcttctagaatctggatgtcttttttcttccccagatttgggaagtttggggcaattaatttttaaataaactgttttttttttctctttctctttcccctctgcaacttccataatgcatacaggggtctgtttgatagtgtcccataagacccttagattttgttcattctttttcattcatttttctttttctcttattgcataatttcagattacccatttttgagtgcactgattctttttttctgcctgatcaagtcagctgttgagcacttctagtgatttttttctatcactgtagttattgcattctttagctccaaaactttctgcttcattctttttttaaaggaaatttctctctacttcgaaatgtcattttgttcatgcatcattttcctgagctcattaaaaatcttcatgacaggtattttgaattcacttttaggtaattcatatctgtttctttaaggtcaatttctggagatttattttgttctttttttttttcattgggccatttttccttgtgtcttgtactttctgtgattttgtgttggtatctgggtatttgaaaaatcagccaactctcccagtctttaaggattagctttatacatggaaaaatcttaaccaacaagcctggctagagattctgggggcctctcaagtcttttctgtgaatatgtcttctctagacatgtgtgcagattcctaactagagggatttgccagtttcttgttttaaggagcttgtaatctcttgctccttctgtgtctttttgtttcacgatgggtcatctgaagcagaaacatgaccatacagtctagcccttttttacttgcagtggaaccccaggtatctaaagtatgctgggttctgtcagctccccacatcaagatagacagaaaccagtacctcaggcagtcccatgaaaagccagatgttgaacacgtgttctagtcttctatttctccctgaataagaaactgccaacctctattgacctctgtctgctgtaccatgattcctgggtagcagcagcgtgatgcacagctcttttttgttgtcacggtcccccaggtatctagaatgtgcttgcccctgttagtgctcccagacaggtgggcaaaagccagtccctcatccagccccctggaaagtaaaaacattggaagtacagcccagtcttttatttccctccccagggagaagccagaaactagaagctgggagttttctcccaagcatatggcactctattgggggagagattatagcatgagtgccatgaattttcatataggcttggatgtgactggctttgtacttgtctggagtgcaggagccccttaactggtgtctggatttctcacagagggagttagtccatgttttattgccaaatctgtctccatgggaggaaggaggatctaatgcttcccattttgccatttcatgatgtcactctctgtaccttgggcttttttaataggagagagaaataaacttctattgtgcttacaatttttttgcatttttatttttgatgcagctaaatctaatcctaatggatacaaagagatcccttctttgagtggtagataatatgatactttaaaactttacaaatctaggagtatataagtctaagattcagtgcatttttttctcccaaatattttatgaaaaagaggaactttaaaataataatgagaatatatacaaatataattcccaggaaagaaaatcctcctctttatttttggttttacagacaggaaaataatgggcctcatgctgttttggttaactgggaaaaacagaggagatgtctggatagtaacctgttagctagcctcacactccacatctctcctttttgggttgtatacttagcctgcatcagaaacaagaatcagcttgtattaaataaatggtctcactttatttatatttaatcatttgggaaatgaaatagaaccattagaatagataatagatgtcagttttaaaaataaatactgaggcaaaataaatttctttacttttccatgacatttttctggaagcaggagcctattagactgttacgatgttctattccattgacttatctccaggttcccttttttaaaagactcgatcttttgaaatgcctttacattcaccatttatatgtacttacctacttaccacttctgcatcactagtactctgtctgaattcaaattttgtatgtctcatgcaaaactcaaaatccaactgtgcagcttcttgaccaaaaaagatgggggggagtgctgaatgtcactatctaaataaaaaagaattttactgagtagtggtggcctggagattgagttatgtggaggttctaattgtgaatttcaagtaaatatgagtaagccacccatttggatggcacacagaaatatactattaataattttctggaacatcttaattgaaagagaaaatataattagaaagtgaagacactcattttatttctcaactgagcttggtttgtataccttctagccaaaaataaagcaaatttcttgttcagtatttccagaagcagctctaataactaaatatccaaggacatcttacagaggtttttttccccaaagttgtgagagcttggtaaagatcaactgtgggaaacttctatggaacttaaaagattgaaaacaactaagagtcccccctcagatattgtctgcttatcctctctttgcagatctgctcattcacatagctttctgtcacatgcttttactttcctgtttactctttctgctgcagaaccagacagccttgaaaagattaactttattctgtgtcatgcatcaacaacacaatttgtcaacttgaatctttattaccggtgatcacataaaagctgaaaaacacaacatgatttctttcttcacctagaagttgaatttgtcaccctaaaaaaaattgctaggcttgtaaacggaacacattttatttaagaatcattcagaaagaacaaggaaaacagactggaaggagccaagatggccaaataggaacagctccagtctatagctcccagcgtgagccacgcagaaaatgaatgatttctgcatttccaactgaggtacggggttcatctcactggcgattgtcggacagtgggtgcaggacagcgggtgcaacgcaccaagcatgagccgaagcaaggcgaggcatcgcctcacctgggaagtgcaaggggtcaggtaattccctttcctagccaaggtaaggggtaacagatggcacatggaaaactgggtcacttccaccctaatactgtgcttttccgatggtcttagcaaacggcacaccaggagattagatcccgtgcctggcttggagggtcccatgcccacggagcctcactcattgctaacacagcagtctgaaatcaaactgcaaggcggcagcgaggctgggggaggggacacattcaaagctgtgtgtagagggaaatttatagcactaaatgcccccaagagaaagtaggaaatatctaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaatcgatgaatccaggatctggttttttgaaaagatcaacaaaattgatagaccgctagcaagactaataaagaagaaaagagagaagaatcagatagatacaataaaaaatgataaaggggatatcaccaccgatcccacagaaatacaatctaccatcagagaatacaataaacacctctacgcaaataaactagaaaatctagaagaaatgggtaaatttctcgacacatacactctcccagcactaaaccaggaagaaattgaatctctgaatagaccaataacaggctctgaaattgaggcaataattaatagcttaccaacaaaaaaaagtccaggaccagatggattcacagccgaattctaccagaggtacaaggaggagctggtaccattccttctgaaactattccaatcaatagaaaaagagggaatcctccctaactcattttatgaggcgagcatcatcctgacaccaaagcctggcaaaaacaaaacaagaaaagagaattttagaccaatatccctgatgaacatcgaggcaaaaatcctcaataaaatactggcaaaccgaatccagcagcacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttaacaaaattcaacaacccttcatgttaaaaactctcactaaattaggtattgatgggatgtatctcaaaataataagagctatctatgacaaacacacagccaatatcatactgaatggacaaaaactggaagcattccctttgaaaactggcacaagacagggatgccctctctcaccactcctattcaacatagtgttggaagttctggccagggcaatcaggcaggagaaggaaataaagggtattcaaataggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaataacagacaaacagagagccaaatcatgagtgaactcccattcacaattgcttcaaagagaataaaatacctagcaatccaacttacaagggatgtgaaggacctcttcaaggagaactacaaaccactgctcaatgaaataaaagaggatacaaacaaatggaagaacattccatgttcatgggtaggaagaatcaatatggtgcaaatggccatactgcccaaggtaatttatagattcaatgccatccccatcaagctaccaatgactttcttcacagaactggaaaaaactactttaaagttcatatggaaccaaaaaagagcccacattgccaagtcaatcctaagtcaaaagaacaaagctggaggcatcacgctacctgacttcaaactatactacaaggctacagtaaccaaaacagcatggtactggtaccaaaacagagatatagaccaatggaacagaacagagccctcagaaataatgccacatatctgcaactatcagatctttgacaaacctgacaaaaacaagaaatggggaaaggattccctatttaatatatggtgctgggaaaactggctagccataagtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaattaaactgaagagcttctgcacagcaaaagaaactaccatcagagtgaacaggcaacctacagaataagagaaaatttttgcaatctactcatctgacaaagggctaatatccagaatctacaaagaacttaaacaaatttacaagaaaaaaacaaacaaccccatcaacaagtgggtgaaggatatgaacagacacttctcaaaagaagacatttatgcagccaacagacacatgaaaaaatgctcatcatcactggccatcagagaaatgcaaatcaaaaccacagtgagatactatctcacaccagttagaatggtgatcattaaaaagtcaggaaacgacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggattataaatcatgctgctataaggacacatgcacatgtatgtttattccagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaaggagagcacatggacacaggaaggggaacatcacacacccgggcctgtcgtgcggtggggggaggggggagggatagcattaggagatatacctaatgtaaatgacaagttaatgggtgcagcacaccaacatggcacatgtatacatgtgtaacaaacctgcaccttgtgcacatgtaccctaaaacttaaagtataattaaaaaaaagaagaaaaaagaaagaaagaataaggaaaactaacaaaccaaaaatgtatgactcttttctaaggagaaccaacttagaaaaagaggaagaggcaagaggttaggcggtaagctggcagtgataatccacttctcaaagcaactacatacagaataataatgattttggacaaatgctaacatttattcagagctagacataaagttaaacctttataggcattatcctaaccatgcttcgagaaagatcccattgtctttaccaacttacagatgacagaaccaaggcttaggaaggttaaataactttccctaggtcacacagtgaggcttggtggagcaggagtttgacatcatgcctcatttcaatacctccacttgttcattgctcaaaggctcatagaattctctgttatcaataatcctctcaaatgtgacttcagcaaatatttttcttgctcccatccatacctacctagctgctctaatcgaatcacagcaaactacttcaaatggccaaaaaaccctgaattattccaggtctccttcttttgcaagtgacagacccctatttaagtaaaagaaggaatgtattgggttccataattgaatagtctttcagggaaggccagatgcaggcattttaataatgtcattgggtcacactttttgtcatacttttttttattataatttttgttttattggtttatttttcttttttattctaagacatcttgttatttatagcatgtcatactttttttattactcagttctgctttcctctgtgtggtttaatcctaagcatgctttctccttgcagtcataagagagccagcagtagctgtgggtttaatccttctacattagctatcttagctttcccaatggttttagccaaggaagctcaggattgcttctccttgggcagacctgggatatatgctccctcttggggacatggaaatggtatagcttcttttaaatcacatgttctaggaatggggaatggtggtatctcaaaataaactcaagatgttgctgatagtagaagaccattaaagccgggtggtcaagcttcctcattctgaagtctagctacatacctttatccgtactatccctatattaaccaatttccaaagctcacctctatcaacctccttgttgttctgaatttttaaccttcaggacatattgttaacattttattgctttactgtttctctttttacatcatgagactgtaaagccacactcaggttttaaaactgaatgagctattatccttcttctttatgcctcatatctattccactgcatgtattctttggcatggtggatagtacctttgttggtccaattgtccagagcagaaaccagccataatctttgacttttatcctcctttactcccacatccagttgctcataaaaccctgtaaacctgctcgcttcagatctcttgacttcttccaagtctcgccacccttcctgctattgccctagtccagatttcctcatttcttgattattctacttactgctctgacatatggtcctcctttaaatatgttctctaatttttcaagaaaactcatcattctaaagcacagatatgatcccacgactctcctcttcagaacctttcagcgattccctgttgtatgatttccatggaccttggtttccttattgataaaggaaaggcataaagagatgatctcttggagatgatctccagctccatgattctgttaatccttgccagcctaaagcagttagctctgtttaatcatttggtaatggatttgtctaccttttggattatagactgagaccctgttttttgctggttattgcccctttctgtatctcaacagaatgctgggtcaagtcctgtcgagcagtcatcgcatattgagaacagctggctacgtatgaccatggccattccagagtcataatatgaattatttggaagatatctgctcttttaagtaccacctcttgcattcatgcaaatgtataaaaattgtatatgagaattactttgaccttacatgtttgacattggaatttcttacaataaggagaactgtgaatgtgcaagtgaaaaagaaataagacaaaaagcagatgtgttaatgtattatcaacactaggctattatcaggttatttaatagccattgaactataccaccataggaatttataatcactcttttccttctacccttctgaatgctggtgaaaaccttagaaatgaccacatgtaggaagctcttaaacgtttccagttaaataatttactctacctaaaggaatatctacatccccacttgccaatttaatgtaccttacacagatacattagtttacaatggaggaatacctgttttagcagtgtcccatacagcaatgttatattataagtcattcaaatcactcatccatacacacacattgtaatacccaaaggtataattgacatatactttcttcatatccactaagctagggtgtggaccattgctccttcttggccaatgtgacctaatcaaactcagttgcccctccttcaggtggaatggcgagtgccaatttgcttgcttatttcaggtggcttttaattctgggattacatgtgtactggcgatcatgattagcctataatggctaacaaagtgccctaaattgataaaatgggaagtagagggaaaaaaagacaataaagagaatcaaatcctatgttagaatgcacacttctgtggctgcttttggcagaggtgtataatcaagcaactggtcaggaaattattctagtggagtaatgatattacaataaataacgctgcatccaaattaagtataggacaattagaggtggggcttcaaagaaccctaatacttcaccctaccctgtatccataccctttgtcatgcaactttgacattcaacaaaaacaccttatatttcctcatgtgatttgccaatagactaaggcagaaaagagtgtgtggtcctgagactagaccctcagaagtcttgcatgtctctgcttttgctttagcccctctgccattgccatgcaagtatgctggggttggccagctaaaagacagcaaaacccagccatggatggaaagaaaattttgacattatgaagagcatcacagacatcaataaatatctattgagcacatacaatgtgtcaggcattgatctagatgccaagcatacaagaggaaacaacacagacaaaatttcctgttattatgggggttaaattttagtggagagagatagatgggaaacaaaacaaataggtaaaatatgtagtcattagatactaatggttggtggaggggtagtaactttaaactaataagttggagaaagtctcattgaaagagaggtgaagaggcaagccatgaggtaattttttgaagagtattcaaaggacagaaaactgcaaaggaaagaggagaattagggaaaagtttccaattatgttgttaatctaataaaatagggatgagtcaccacagaggatatgctataaggaatgaagaaagcactattcagttatctcaagcatttctaggatgcaccctttgaacaaaattttggaaaactttttgaaagcatttctaggatgcattatcccataaaatgtattaaatcttaattggtaaggtttgacagttatacaattactgattttttttcatattcacccatagagagcaataatttgcataagagaaaccctgattttaatactctcttttctggatagttttgcataatttttatgcgatttccttgatgaacccaataatactctcttccatccatagttttgcataatctgcataataaggacgtactgaagaagaactaggaactgagcaattcagcaagatcacagaaacatgtgttgggagctgcctgtcagcaaatgctgctagaaattctgtgactatcaggacaaatcttgcagataatggtaaaataaatggccttggcaagattttgtatagactgcatatttcttgtggggtcatcactacttttaaagaatccaactggaattgttatttcagaacacaacgttttgggtgcctgcatacttctctgtcttccagacttctctaaaatatttatcttcctaactgctcattgccctgttgagtgtagactattgattagaggggacttccagagcattggattatgggaagctagcaggacattccagttaccttgctccataacacattatcctaaaacttcgaggcttataacaactatatttttgtttgtaattttttgggtcaggaattctggaagggtctgggatgatggtaatctgaaggcttgactggggtggatatttccaaagtggttcactcacatagctgtcagttgatgctgtcctcgggctgtcaatccaagcacttccaggtgacctcttcatgttgtctgggcttcctctcgataaggcagcttcagggtagtcagattcttacaaggcagcccaaggctccaaatgtgagtgctgcaacatttaagatggaagctgcattactttttataattaagccttggatgccatacggtgttatttccatcacattctattggttacaaatgagatataagcccacccagaattcagaagaggttgcatgtacctccctcctgatgagaggaatgtcaaggtcacattgattgcagaggaacatgtggcataggagatattgttgtggccatatttgaaaaatataagctgccacacagggttaattagcaaaagtagaatgtgtgaagaccccgaattcaaggtaaagtatagaggtcaccatatcttgtagagaaacagacaagagcaaaaactgcagaatgtttacattcttgtgctcacaagaggaaaagggtccaagaatataggaggagtttagacatgtcaggctaaggtttcaaaaaaggcctcactctgtgttctatactttagggtaccttaagtctctcatggcactctcatggtaattcattcattatttcataaactttcagtaaatatctactacagggagtagtggtagtagtagcaatagcagtagcagtagtagtggtagaatagagactattctaggatcttgcatatcagtaaataaatgcaagaaaaagccctaccctcatggagagtatattctagtggagtagtgatattaaaataaataacactgcatgcaaattaagtataggacaattagaggtggggtttcaaagaaccctaacgcttcaccctaccctgtatccataccctttgtcatgcaaatttgaagttcaacaaaaacaccttatatttcctcatgtgatttgccaatagactaaggcagaaaagagtgtgtgctcctgagactagaccctcagaagtcttgcatgtctctgcttttgctttagcccctctgccattgccgtgcaagcatgctggggttggccagctaaaagagaagagacatatgggccagaggccagtcacctcagtctccccaagcaagacccaacccacctccagacacctgaatgagcccagccaagatcctagatgcataaacattaaatttactgccatatgctattagattttgtgattgcttttcatacagcattttggggcaatagacagatgacacaactgggaaaaagtggaagagctcgttttcttggagacgtgtttacacacagttctattttgaagccagttagcagatccctgttgttgttgctggcgctacctctaggctggagtgtttcgaagaataatcagagtcagaattaatagagttgcctctagattcatgacaagggtgagtgaggtgtggaggaatgaagtggaataaggcttcatttctgctggtaaaggctttattttatgtttccttgtctgaggggacaaaaatcacctctaatgtctgttatggttgagggatgaggaaggaagtctcaaggagaaactcaacattcctgttgcttctttgatgccttttcctcctttaacatatcaagctccctgcctaaaagtggacttttatcattattattattattaaaaataaacctgttttggcagcatcaaagggggacgatggccatactgtccttgaactatgtggatgtgtcagtcctggcaatcatgttggcaaactaaggttctttcccagactacatcaagtaagggtggaggggcagggtatttaatatctgcttcccaatcatggtgacatttaacacttctgaggaaaaaaaaatgcctccaaactggcctttcaagtaagtggagtagttactctccccacaaagtatcagaaactgttctatgagccacttactcctttatgtcttgcacagtccctatcaaaagtcaaatactcctgggagacgtgacctctttagtcttcaagagtcaacactttgggaaaggcagaattatttcaaacagctgagcacaagaaaggcaactagcttgtgtaattgttcattttctgttttttcctactgaattgtaagctacaaggggtctaggaccatgtctatcttattcatccctctatttccaggtttcaggacacataggagaccctccacaacgcccttgggaaaaaagcagaagaggacaaacatgggaaaagaagggagggaagggggagataaaaagcctaattaaattctcacagagcgtttatcctaatattaactagttaatgacctcaagatatgtattgagcttttactatgcacgcatggcaggaggggcgtgccccttccttgccttaacctggtgtggttctttgactttttactcctgtatactcgaagaaaacaatacaaaaatcaaagctgggaaaaaagttcctgtatggggtatttcaccgttttaatgcattaaacatgatgtgctcaaatgccccagcctttgggattgaaacattcataatgagaactccgaagcgaccaagatgaaatacaaacttcaaagaaggcgcccagttttgtcttgctactctagcctagttcagtggcgcctcaaactttaatgtgcatgcgaatcacctggcaatcttgctgaatattcagatttggagtcaataggtctggagtgaagcctgagatgctgcgtttttaacatgcccccgggtgatgctgatgcttctaacccaaggaccacactttgagtatacaagggactggagaccatcacctctaccgccaggtgtgtgtatgctgagtcccagcgttccagatcagtgtcccgcacgtcctcggccttctgccagtaggggaggagtcgggggcggagcgggaggagtggcgcgggccccgcgtgggtcctgccagagatcacctcggccccttgaagaggcagccaagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtaagaggtagcccgggccgcgggagggcgctcgccgcctgcccggcctcctttccccggactccgtggctcgggcagcactgtcccgagttgctctccaagtctttgttactcttggtgtggtgctagcatttcttcagtcccttgaggtctatctcctgcttttgtccctcttctttcctgtcgttttcagtctctcatttgttgagattcggcgtctctgcgctttgttcgtgtttttacgtggcatcactccagatgcctgttagctttctgggggatgacagtgtggccctttcaagtaagatgaaaacctcagaaatggaagggatttcctttcctttgactctgctgtcaaaagctgaggcatcctcgaatgttagagtgctagaaagtaatggaacttttcggggccgatgtggaggtaagttgcttctggagccctgggtctgtaaccaagaataactgctcagctgtgggtctgatgtgtttactgttttgcttactattcagttcaacccatggctcttattaaatgcatatctgataggagtgtcccctttaaaaatacataaatgtagacggaaacgtacccggaaatgtaccccattgtggttgaatgtgcattatttcacttaaaaatatttgcttaggatgggcaagaccacagctttcttgacagggcagcttttcttgatgaataactttacagtggctcctaaaagtgaattggttttcacatacatattttttcctggactcactttgaaatcagcatgtggttattagaagagaatatgccagttcctgtggagtaggaaaaagaacaaaactctgaaggatcatagtgactagaacggagagagaggcactttcattcataatcccctggagccaactactgttctagggaggaagtgacacatttaacttggctttatttaggtgagaaaggcgtttgaagaaaaattaaaggtatatagagtgttttaaaagagtaattaacttagatcacctctacagaggcagacagggtttttttttaatagcaggtgaggttgattcaagtgagaaaaaagattactaaagaatgtgcactgtgttagctgggcagcaaaggtttatgtcacaaagttgtcttgaaatagtttgctctgcttctgagtcactgttaactgccagcagtttttcaaatgcccttccagttgtagaaaaccttttagaaggccacagagatatttacatatcatttgcattgcatttgcatctgctcccctcaccttgtagtctggcagcaggcaattttcaaatttttttttccaattgttttccttaatcttgcctcttcccctttccatgccttgaggccttttttccagaatggaatgggaagagtgtgtgaccactagatcacacaggtggaagcagaccagaaggactctgcccaaaaactggtggttcaggccattctgcaacactgatccacacaagacatctattaagacctctcttctgccctcctgccaaaccaggtctttttttttttttactaatcgagttgaggtgctttggcccctgctcccaggagatggaacaagcttcaaggatagcaaaaaaaaaaaaaaaaaaaaacccaccaccaccaccaacaaaaacaggtcttaacctgagcctgagcaaaccagttagttccagtgccagctgcagctgtgtcaattcaagactttctggcttgaaaggtgtagggcaggggctaagcatgccaggctggaagccctttgaggggaaagtagaagttttataccccatcccctccccgcaaatcctagccagcacaggactttgtcctcagtaggtgatccatagaccttgattagattgaattgcgaatttgtgtcatttctctataaataatctctcagtatgtcctgggtttcttcccctccgatgtcatttatattcacattcctctggcaattccctcagttatcgctctaatttagatcctccccacattactgggcacatctttgccacctaataaatagttgaatgaatgaatcaccatatattgggattagtgcaatatactttgagctagaatctcccactcaagccgttccatctacctctaagaaacaaatatttcaaaagacatttttcatcatgttatttccctgctcaacatactgcagtggctccctattactttttctccagtggcttgtcatctcacaaagttatgattcttaaaaatagccgagaaggccccacatgatctagcctcctacactcctactctactccttgctcattcttcttcaaccacactggccatcttcctgttttagttactttcctgtctcaggctgtttgttcttacagttctttctacttggaacactccctctagatatttatagctagatctctgaccttgtataggtgtgtgtgtgtgtgtgtgtgtgtatgtatatatatatatatatataatttttttttgagacagagtctcactctgtcacccaggctggagtgcagtggtgcaaccatggctcactgtagcctcgacctcctgggctcaggcgatcctcctacctcagcctcccaagtaggtgacaccacaggcatgtgccaccacacccagctaattttttgtactttttgtagagacagagtttcaccacgttgcctatgctgttctggaactcctgggctcaagtgatctgcccgcctcagtctcctaaagtcctgggatgacagtcatgagccactgtgcctggccttgtataggtctttacttcctcaatgaggcttttcctgactaccctatttaaaattgcaaccccaccctcaacttatccccctttcgtgatttgttttacttaaattgtttatttatgtcttcgctgattagaatgtaagctccataagggtagacatttttggtttcattgatgttcattgccaagactgcctgacacatttttagatgcccagctttgtgtgtgtttgcaaatatcactcaattttagtggtgtcccatttatcaatattttcctttacggtggtagttttggtgtcatgtttaaagaaatcctttcctactgccaaagtttcagtaaatatttgttaaatgaatgaatgaatgaattatagtttcttccaattatttttcatggcttaagctcaaccaataaagcagtgcttcttaaactttaatgtgcttaggaatcacctgcagatcttgtagagctgcaagttcctgggtgatcctgatgttgcggtagagcatgctttgaatagcaaggcaatactgtgctgcataggttttggcattatacctgccacctctattaaggcatactatgagacgccattctatgaagcttgatatgtttatttaaaaggtctatagtttagaatgctgattactatattctacctttcactctaaagacccacaagaggaattgctctcagattgtagagacagtaatagttgtgtgactcctggcaattgattgaatttttaaaatcgtcaaaatatgtcatgtaactgattctatttctcactttgtgttggctactagggagtgtatggctagaattgtggtccatataagctagcgtacagtaccttagcagatctatatttatgtgtggacatttcccctgggtttatctaatttgtttcttccttagtttacccttttctaggttcttttctttttatttgattttgttgtttgtatttatgtttataaggttcagatataagaaaaagatgtatgtgtatgtggcaagagacagagaatccctctctccaggcatgtattttcacttaacttggccttcctggaatagttccaagggtttcttaggcagatatccttgagcaatggggcattgaagtctcaagaaatcatgccataaaaacttatattgggcccattcggctttccactgattggtggaaatgtagcagacaacggcagagggattctggggagacctaggatctcagttaaaataataattctgccactgagtgatcttggaaaaatattttaacatcgttgaggcttaatttcctcacctgtaaattgattaataagagcttcttcgttgacttgttctggttttcattcattcattcagtaaatgtcaggtttctacatggtgtgaggcaacttactagatgcttgggttcagtagtgaaccaaaaataaaagtctgttggtgaagaaaaaaataacatcagtctttttagataagtgctcttagggatgtaatcaggaactaactgaggacaggtggcaaaggggagggctgctgtttggtaggaaagcttctctgtggaggcagcgtcctggcttatcactagagcatgggaaccaagtggctgctctaagaacaggcattccaggcagagggcaagagcccctaaggtaggaaatgacttggacatttcaaagaaatagaaggaggctagcatggctggagcagagagagagcaggggatagaggagtttgaaaccatggaaggagacatgagcagggtaaaatcagatcctggaggcccaagttagtcaaagttaggagtctgcatttgtttcgtgtttaaaggaggaaatatcttgatctgacttaccttttaaaaagatcgccctggttttctgtattaagagtggattgacaatattaagaatgataacaagggggactggttatggggggtctaaaccccttttgtgccaaggactccttgtcagtctggtgaaacctacaggacctcgtcttagaataatatttttaaatgcataaaataaaacacacagaattacaaaggaagtcaattatattgcaaccatgttaccaaaacatttttaaaatgtgtgagcagtagcgtatgtgctcctttatcaacacattaaataagattttacagcaggctaaaggatgatgatacttttgaaacagtgatgagagtcaatgatattttgagataccttccacagctacagtgtggtatgcatctgtgatttctgtaggtgacaaagttacaagtacaactagtggtttgtagtttacatttgtaacgaaatgctaatttgtttaagtaagctaggaaacatgtagatgtgattttatttccccagccaaaggagactggtttggaagttgctgtgatgaccagtcctagataaagtacctagtacagtgcttggcacatagtagctgctaaatggaatcaatggtagcctttttcgctactactaacagaaaacctaaggtaattctgaatatcagatagaaaatgatacttaatatgacgtatctatcttcctgctgtgatttgaaaacaacaacaacaaattattgcaaagttgttaattgggtctttggctcatttctaaggcaggtggttggcagctgtataaggggcaatgcttttagctgtaaataacaaaatgcccaataaaaagtcatctaaataatgagaacatttattacctcacttagcaaggagtggaaaactaggccactccaggattgtttcagcaactcaggagagttatccaaatccaagctctttccaggcgttttctctgctattctcagtgtttgagctgtttcacctttcaatgttgtaagatggctgctgtcattgcaaacatagtgttcccctaactgaagtggtgagggaaggtctgaggctttttttccccctgcatctttttctaaagtcatgtagaacattctatcctggaagaatttccctctgactcattgcccagcacttggtcattagccagttctagtttcagggaggctgggaaggctagtgtttttatttttaaccttgatcattgacaggtaccgacacgaaaaaagggagaaggaaatggttgctggttggttaccaaagcatctgccatttggcgtcccttggcaaggtctgtcttgtgacctcctttatccattcgcttttcatctctttggtgtttcttttcccttttccaggtcacctccatgtgtcatgacacctgtaaggtatcttgtttttgctgtcagctagttgccaattaaataaaagctaagatattaactattaattaagatttaaactagcaaagtttggggaatatattttatggcagcaactgtgtttttcctaccttttcttaaaaattatttctctcatcaaagatataaaacaaaatgagtctttatttattaaaaatttgttttaggccaggcacggtggctcatgcctgtaatcccagcactttgggaggccgaggcgggcagatcacatgagatcaggagttcgagaccagcctggacaacatagtgaaaccctgtctcgactaaaaatacaaaaattagctgggcatggtggtaggtgcctgtaatcctagctactcaggaggctgaggtaggagaatcgcttgaacccgggaggcggaggttgcggtgagccgagattgcaccactacactccagcctgggcggcagagtgagactccatctctaaaaaaaaaaaaaaaaaaaaaaaattattttaaaagttaacatgttttttctttttttagaacagtctattccataaaatacctgtattttatccacttatacaaattatcatattatacatatattacacagcttgctttcttgcttaatgtacattggacatctttgcatattgtatagagagatgtaacatgtaacattctttatactggttccatttaatggttatactataacccttattgatggacatttgggttgattccagtttttctcctttttttgctatcacaaatagtgccataaataatatacatgcatatacatatacagtagtcccaccgtatctgccagggatatgttccaagaccgccagtggatgcctggaaccacggatagtactaaacgctatatatactacttttctgatctgatacctgagacacttactaagtgaccatggggcaggtggtttacagagtagatatgctggaaaaagggatgattcatgccccaggtgggaaggagaatgatgtccccaaattttatcatactactcaaaatggcatgaaatttaaaacttatgaattgtttatttctggaattttcctggtagtatttttggaccccggatgtctgctggtaactgaaaccacagaaagcaaaaccttggataaaagaggactgctgtaaaatgcatatatacatatataatgtatacatgtaatatatatgtgtgtatatgtatatatcttttcatatatgtatttttgcctacttttgcaagtatctatgtagggtaaatttttaaaacacaattgctgggtcaaagtttaccaatattttttatttgatagaggattatcaaattgccctccaaaaatgttctaccaatttctattgtctccatcagcatttgggagtgcctgtgttctcactgggtttcatcagagtttttaatatatgctaaactgacgagtataaaattaggatggaggtttccagggtagaaactgagtccctttattgtttctttcaacttttaccaaacaaaatgcatgtgtaggatttcattcagtctttggatttgagcggttcccatttttaaggcaggtgtgtgtttcatactgtgtaagtaaagcctgaagtttggcttgaaatggcagcagggttgggcaagctggatttttgtaggctgggttcaattcctaattgcctgattacagatctaccaggaagcaggcacttctatgggctatggcttagaccctttgttatgcatgacccagaacccagtgaatgataaaatgcagtgatgtaataaggactaacgatgactgatcacttatttccacacactgttgtaagtttttttcatgtattatgtcacttttcaaaatgtacctaagtgtaattttgtttgttaaaattttttatctttaattcacaatcattatatatatttatggagtataatgtaatgttttgatacatgtgtacattgtggaatgagcaaatcaggctaattaacatatccatcacctggcatacttatcatttctttgtggtgagaacatttaaaatccacttttagcaactttgaagtatagaatacattattattaactatagtcaccttgctgtgcagaagatcatcataacttattcctcctgtgtaactgaaactttgtacccttttaccaacttctcccctttccctccccatttccccccacccacctccagcttctggcaattaccattctactctcaccttctatgagtttgactttttgaggttctacatatatgtcacataatactaccaacaactttataacatgggcaacattattatctccatcatatccagtagggaaactgaggaacagagaggttgagaaacttgttccagatcacacagctagtcagtggcagagatggggttccatcttccccaggctggttgccaaatctgtgatttcaattggtgatcctcatattttaatgtgcatacaaaccccagggatcttgttaaaaatcagcttttagctcagtgagtctggagtgtggctcatgattctgcatctctactgagcttcaggtgatgccgctcttgctggtttatggagcaaacttgagcacaacactctgaattacaatttttttccccaattttatggggttgcctgtcaacaaatgtaactgctcctgcaaacttcatgattttcatcattttttcttgtactgaggatgacttcttccacaggtgcaagaataccagctctctggtttgtgggttatactgaaggaaagaatcacttcctgctgcatctccttgtaggtttaagggatatgttgacatctattgaatgaatgagcaaatgcatggatttctttttcctaatagatgtaatttttcactgtatacagcaagtttttcaaattcctttaaaggcccaaacaaatcacatcccagcaattttaaattatttcatggtaattcaagagacaccttattacatcattcccaaacagaaagcatgagcctgataatcatgataccaagcctattttagagtcattccactgattttacctgtttgacgtaaagtagtgcttctcctccaactctaaatcaatttaaacttaaaatgatcagacatcttcctttttattttctaatcacaatgatttaacagacctactcaaaataatttagaaagctttagatacagtctatttatgtcttttcatctgttaatatacattccacgaaaacccgaacttattatttgtattataatttttttattatactttaagttctagggtacatgtgcacactgtgcaggtttgttacatatgtatatacgtgccatgttggtgtgctgcacccattaactcgtcatttatattaggtatatctcctaatgctatccctcccccgtccccacatcccacaacaggccctggtgtgtgatgttccccttcctgtgtccaagtgttctcattgttcagttcccacctatgagtgagaacatacggtgtttggttttctgtccttgcgatagtttgctgagaatgatggtttccagcttcatccatgtccctacaaaggaaatgaactcatcctttttttatggctgcatagtattccatggtgtatatgtgccacattttcttaatccagtctatcattgatggacatttgggttggttccaagtctttgctattgtgaatagtgcggcaataaacatacgtgtgcatgtgtctttatagtagcatgacttacaatcctctgggtgtatacccggtaatgggatggctggatcaaatggtgtttctagttctagatccctgaggaatcgccacactgtcttccacaatggttgaacttgtttacagtcccaccaacagtgtaaaagtgttcctgtttccccacatgctctccagcacctgttgtttcctgactttttaatgatcgtcattctaactggtgtgagggggtgtctcatcatagttttgatttgcattcctctgatggccagtgatgatgagcattttttcatgtgtcttttggctgcataaatgtcttcttttgagaagtgtctgttcatatccttcacccacttgttgatggggttgtttgtttttttcttgtaaatttgtttgagttcttgtaaatttgtttgagtaaatttggttgagttcttgtagattctggatattagccctttgtcagatgagtagattgcaaaaattttctcttattctgtaggttgcctgttcactctgatggtagtttcttttgctgtgcagaagctcttcagtttaattagatcccatttgtcaattttgacttttgttgccattgcttttggtgttttagacatgaagtccttgcccatgcctatgtcctgaatggtattacctaggttttcttctagggtttttatggttttaggtctaacatttaagtctttaatccatcttgaattaatttttgtataaggtgtaaggaagggatccagtttcacctttctacatatggctagccagttttcccagcactatttgttaaatagggaatcctttccccatttcttgtttttgtcaggtttgtcaaagatcagatggttgtagatgtctggtattatttctgagggctctgttctgttccattgatcgatatctctgttttggtaccagtaccatgctgttttggttactgtagccttgtagtatagtttgaagtcaggtagcgtgatgcctccagctttgtccttttggcttaggattgacttggcaatgtgggctcttttttgattccatatgaactttaaagtagttttttccagttctgtgaagaaagtcattggtagcttgatggggatggcattgaatctataaattaccttgggcagtatagccattttcacgatattgattcttcctatccatgagcatggaatgttcttccatttctttgtatcctcttttatttcattgagcagtggtttgtagttctccttgaagaggtccttcacatcccttgtaagttggactcctaggtattttattctctttgaagcaattgtgaatgggagttcactcatgatttggctctctgtttgtctatcattggtgtagaagaatgcttctgatttttgcacattgattttgtatcctgagactttgctcaagttgcttatcagcttaaagagattttgggctgagacaatggggttttctagatatacaatcatgtcatctgcaagcagggacaatttgacttcctcttttcctaattgaataccttttatttctttctcctgcctgattgccctggccagaacttccaatactgtgttgaataggtgtggtgagagagggcatccctgtcttgtgccagttttcaaagggaatgcttccagtttttgcccattcagtatgatattggctgtgtgtttgtcatagatagctcttattattttgagatacgtcccatcaatacctaatttactgagagtttttaacatgaagggctgtttaattttgtcaaaggtcttttctgcatctgttgagataatcgtgtggtttttgtctttggttctgtttatatgctggattacgtttattgatttgcatatgttgaaccagccttgcatcccagggatgaagcccacttgatcatggtggataagctttttgatgtgctgctggattcggtttgccagcatttttttgaggatttttgcctcgatgttcatcagggatattggtctaaaattctcttttcttgttttgtttttgccaggctttggtgtcaggatgatgctcgcctcataaaatgagttagggaggattccctctttttctattgattggaatagtttcagaaggaatggtaccagctcctccttgtacctctggtagaattcggctgtgaatccatctggtcctggacttttttttgttggtaagctattaattattgcctcaatttcagagcctgttattggtctattcagagattcaacttcttcctggtttattgttgggagggtgtatgtgtcgaggaatttatccatttcttctaggttttcaagtttatttgcgtagaggtgtttatagtattctctgatggtagtttgtatttctgtgggatcggtggtgatatcccctttatcattttttattgtatctatctgattcttctattagtcttgctagcggtctatcaattttgttgatcttttcagctcctggattcattaattttttgaagggttttttgtttctctatctccttcagttctgctctgatcttagttatttcttgccttctgctagtttttgagtgtgtttcctcttgcttctctagttcttttaattgtgatgttagggtgtcaattttagatctttcctgctttctcttgtgggcatttagtcctataaatttccctctacacactgctttaaatgtgtcccagagattctggtatgttgtgtctttgttctcattggtttcagagaacatctttatttctccctcatttcgttatgtacccagtagtcattcaggagcagattgttcagtttccatgtggttgagtggttttgagtgagtttcttaatcctgagttctagtttgattgcactgtggtctgagagacagtttgttataatttctgttcttttacatttgctgaggagtgctttacttccaactatgtggtcaattttggcataggtgtggtatggtgctgaaaagaatgtctattctgttgatttggggtggagagttctgtagatgtctattaggtctgcttggtgcagagctgagttcaattcctgggtatccttgttaactttctgtctcattgatctgtctaatgttgacagtggggtgttaaattctcccattattattgtgtgggagtctaagtgtctttctaggtctctaaggacttgctttatgaatctgggtgctcctgtattgggtgcatatacatttaggatagttagctcttcttgttgaattgatccctttactattatgtaatgcctttctttgtctcttttgatcttcgttggtttaaagtctgttttatcagagactaggaatgcaacccctgcctttttttgttttccatttgcttggtagatctccctccatccctttattttgagcctatgtgtgtctctgcatgtgagatgggtttcctgaatacagcacagtgatgggtcttgactctgtatccaatttgccggtctgtgtctttgaattggagcatttagcccatttacatttaaggttaatattgttatgtgtgaatttgatcctgtcattatgatgttagctgtttattttgctcattagttgatgcagtttcttcctagccttgatggtctttacaatttggcatgtttttacagtggctggtaccggttgttcctttccatgttgagtgcttccttcaggagctcttttagggcaggcctggtggtgacaaaatctctcagcatttgcttgtctgtaaaggattttatttctccttcacttatgaagcttagtttggctggataggaaattctcggttgaaaattcttttctttaagaatgttgaatattggcccccactctcttctggcttgtagagtttctgccgagagatccactgtgagtttgatgggcttccctttgtgggtaacccgacctttttctctggctacccttaacgttttttccttcatttcaactttggtgaatctgaccgttatgtgtcttggagttgctgttcttgaggagtatctttgtgacgttctctgcatttcctgaatttgaatgttggcctgccttgctaggttggggaagttctcctggataatatcctgcagagtgttttccagcttggttccattctccccatcactttcaggtacactaatcagacgtacatttggtcttttcacatagtcccatatttcttggaggctttgttcgtttctttttattcttttttctctaaacttctcttctcgctttattgcattcatttcatcttccatcactgataccctttcttcccgttgatcaaattggctactgaagcttgtgcattcgtcacgtagttctcgtgccatggttttcagctccatcaggtcatttaaggacctctctacactagttgttctagttagccattcatctaatcttctttcaaggttttaaacttctttgcgatgggttcaaacttccccctttagctcggagaagtttgatcgtctgaagccttcttctctcaactcatcaaagtcattctctgtccagctttattccgttgctggtgaggagctgcattcctttggaggaggagaggcgctcgatttttagaattttcaggttttctgctctggtttttccccatctctgtggttttatctacctttggtctttgatgatggtgatgtacagatggggttttggtgtggatgtactttcagtttgttagttttccttctaacagtcaggaccctcagcttcatgtctgttggagtttgctggaggtccactccagacgctatttgcctgggtatcagcagcagaggctgcagaacagcgaatattgctgaacagcaaatgttgctgcctgattgttcctctggaggtttcatctcagaggggtacccggctgtgtgaggtgtcagtctacccctactagggggtgcctcccagttagcctactcaggggtcagggacccacttgaggaggcagtctgtccgttctcagatttcaaattccatgctgggagaaccactactctcttcaaagctgtcagacagggacatttaagtctgcaggggtttctgctgccttttgttcggctatgccctgcccccagtggtggagtctacagaggcaggcaggcctccttgagctgcggtgggctccacccagtttgagcttcctggccactttgtttacctcctcaagccttagcaatggcgggcgcccctcccccagccttgctgctgccgtgcagttcgatctcagactgctgtgctagcaaggatcgaggctccgtgggcgtggggccctccaagccaggcatgggatataatctcctggtgtgccgtttgctaagacccttggaaaagtgcagtattagggtgggagtgacccggttttccaggtgccatctgtcacagctttgcttggctaggaaagggaattccatgaccctttgtgcttcccgggtgaggggatgcctcaccctgctttggctcacacttggtgcactgcaccctctgtcctgcacccactttctgacaagccccagtgaaatggacccagtaccttagttggaaatgcagaaatcacccatcttctgcatctctcacgctgggagctgtagactggagctgttcctatttggccatcttggaaccacatctgtattataattatttaaagagaacatagttcgtagttttttgttacagagtaaatggaaaaataaacacagtaaaacttgttttaaatgaacttaattatttattttgccaataactaaactcagtgctctgtaaggagattgttttaatggaattttattaaatgtattggcctttgaatgtgaaaatgatagattatattaatttcttactaacttcttcactaattacacttttgctggttaatttagtaaatgatgtttgtcatgtgattggctgcaacacaatatacaatggatttcctccaagtgacagggcggtcctgtagtgtccccacatggtaatggtctctaggtaaactggttcaacagttcgtgatgtgtccaagtctttctcttcatgattcaactttacaagttcatctctgaccaccagtcaagtaccatgtcttgactggtttgtctcataaaaaaacaagttgttttcattatacacacacacgcacacagatatatgtatgcatgtgtatataagatacacatgcacacatcactaaactcttcctaattattttctttatggttttagttactagggaaacctaccaagataacaggcccattattcttggggtgctagccacttgatcaaactgaattttcaagaagtatttgatctttctttttgcaagctgaataaaggagtgttttgtgtaagatcagattttcttttctgaatagctttaaccattcaatgaaccaaagaaatgaatgactttggcctgttaaagtgtgagtatggctatctgggtcataaagaagcggtttttcagatgagagacaaagtcttacagacttcattggtaagaacatctaaatgagaggtggcaaaacaaatattggttatggcattatgcgcagttagctgttactgtgcccatctgctggctccattgctttgcatggaatggattccccgtgctcagtggtgtgttgaaatctggtgtctatggcaacaaaagcatcaccaatctcaaagcaagcactgttggtaccagctgaatctccactcacacaacgactttaggaaggagacacagtctgacagactttatggctatctaaggccaaagagatccagtgtctaaccagaaacaatatattgtccttatgcatatatcattaacataatcttgctttttaaaatgttttttttttcttctgagacaaaaagaattgcacatttattacaaattgcaattgttgaaatagtctggactctcaatgaagacattaaagcatgatggttaagaacagccttttcagattcaggtagccttgggattgtcagactccactgcaatatctgattgactttaagcaagttatttagcatctctgaggcttaatttcttcaccaacaaaatgcaattcaagcagcacctacctcataggtgtgctaggaagggccactgagaatgtgtggtaacatgcttggcagaggatgctcccaggcatagactacgaattccctctgtcagccatgattttgagtattggtgggcttcagcatagggtgatgagacagtgtaactgcatttacactgggatggagtactccaccaaatgtcagtatctgtgattcttttttcttgaatctatctgacaactataaaccctccttcaacctactacttggtgaagacagtggctgccagtgttctggatattgattctgagtattggtgtgctttagcgtagggtgctaaagcagtctacattgactaaatagcatatgtattcttttggatgttcagccaatctgtcttatattccctgtggtggcattcagagctgctatgtcctggatggcaacagcaaagctttgagattttcacacagaggccttaaagggctggagggaagccctctgctctgccatgcaggagattaagctgagctgctcaggcagattatatgtcaaagtaaattgagtgggcatcacccctaaaacaagaacttgtgtgaattactctgcacttcctccagggaaaggactcttttctcttttaaaaactgtaggatctttgcagtgttataagaattggctttcttgtctctgatttgtgcttcttggagtaaatcacctgattggcttgaagatactgtaaattgccatataggtgatgttggaatatttgcttcttgctctgttccccactccaaccccctattctgagtggtggattcaataagctattttttgctcttaagttctcgtctttgtttctagagataatttgcttacatagcactaattcagattttcagaggaatttcaatagttgtgacactgtcaaagtgacaacttcaaatgagttttcctcagcaaatgttccaggtcatgtacatttattagcttgtttcagaaaacggttaatacagttaaggattctttcaagtgtttcttcagctactgggctcagaaattatttttttcttgcattaatagactcctctattagtatttgaaagctgtgtgatataaagctatgtgactcactgtcagttttacaaacttaaatctgcacttcactctttcattcctagctcctatttatattcatttatcacataatgcttttgatgttaacaactacactactctaataataaagctataattatgactttcccctatccctaatcggggctgggggtgtcatgtgtattgattagctctgcttatgatcttcagtaccacaccaactgggttctaagtcttggctttaatctccatgtgggtctgttatttttttttctgacacaagagtttcttacacgtgaacatgcattagaatcccttgagggcttgttaaaacacacatcgctgggctccactccctaaatttctggagatgggcctcagaattttcacttttaacaagttcccagtgatactgctactgctgctgctggtctggggaatacatttcgagaacgaatttcttagactgtacccttaaccttggccaaacatctctgaaatgtgggaactaggtgagggcatatggcagcagtaccataaacttatcaccactggaaaataaatcaaaagataagacttactgtgtgacaggcactaagataagcatattttcttcattttacaggtgagacaattgtgacttagagaggtttagtaacttgcctatcatcacacagctagtaaagtagtagaacccacgtttgtctgactatataacttcttaatttctatagatttaagtcaggtaatctgtctgcatgtttttctactaaagcacaaggatcttgggcttgcaccccaagatgtttggaagaatagcctgaactcaactcaacactagaaagattcaggaattagaggttctaggcatctctggtgttagtggtggtgtgggtcatgtatgaaaacagaattagttgcaagtttgataaacagtggttagactcccagatactttcccaaatctgagcaaccagatgatggtcttaggccagatttcccaaagatgaccgtgagatgtggattaatatggaattgttgattaaggaagtgttccaaggagaaaccagtataagaatggggaaagtaggaagcagtgaatggaaggaaatgaagcaagagtgtgatcttaggctaaattccagcctctgtctcatcttgtagggaagctctagagtgtatattacactctaggctagaggtacactgttgtaccagtaatgagctccagctggtggtggggggggtatgtacattttcaggtactacagactctcttggcatgctgctgaagttgtacttgtagcccaaagtagggctctaaagaagcctgcaggtgagagttgttagaagcaaagcatatggacatagggggatggactcaaagagctgataaagaagcatctgagaaggtttgatagggaaacctgcagttcctccacctgggccctccacaccttagtagaagccctgagattcacttttttgacagattgaattaaagaaactcagctttgaggcccaaggcacagtccagggcacagtcagtggtacttcactgaaagcagaatgacctgaaagtttacatgctgaattgtgggcgcctccctcctgcacacacatttagttaacctcttcctgaaatccacatccagaacattggcagccactgcctccaacaagcagtaggttgaaggacgatatgtggttatcagatacattcacaaaaaaagaaccacagatacagacatttggaggagtacttcatcccagtgtaaatgcaggtacactgtctcatcacgctgtgctaaagcccgccaactggctagccctttcccatacccagaattgccagtgaactttttaggatgaaactgttaaataggaacggtcattcaaaagacatttgaggaacatgtctgatttaaaaggcagtgatggtaacaaaatatacaaataggaaaacaatcttggaggaaacagataatactgcataagaaaatttcccaaatgcccaaatctataattaatattgtcagagaagaaagtaatcacatgtctgaaatgaaagcaggatattattgaaaggactgttgagagaacagaaaagaactcttagaaataaaaaaaagatagcagaaataaaaataattcagtgcaaaaattagaatattaagttgaataaatgtccctgaaagttcagccaaaagacaatgagattgataataagagaaaagattaattagaaatgtctaacctctgtctagtggtcggtcccaattaaaagaacaaagtgaaagaggaaaattatgaaaaaaagcaagaatattttttataagtgaaatacatgagttgccagatttaagagacccaccagcatattggatgggaaaacaataaagaagagtctctaaaaatttccaaaaaggaagaaacctggtttcatacaaggattagcattggacttttcatagcaatttagaaatttaaaagacaatgaagcaaggtctccaaaattcatagagaaaattcttaactagaattctatagcagccaaaattatcaatcaagtgtgaaagtagaaaacatatctttagctatgcaaggtctccaaaaagataccctttttgtagtttgtcaaaaagagggaatgaaccaaaacattggaaaatatgggatcacaaaacctgaggccccaataccagtggggccacagggaacttccagggtggtcttaaaaggacagtccaggatcacggctgagtattaataccaaagggagaaaaaggagacaaaagtaggactaattgcacatgatattgctcaatgaatattgatttagccaaataatgtgatactattattttgggtaggtaagaaaggagaagtatgtatggagagatcataaaaaagctaaagtttcatattccatgttaacagattaatatataatgcctaaatgaacaaataaagaaatagttgtataaggatgtcatttttaaaatatggagataagttgctaaaaaaatacacagataaaagtgttttaattttttgcctcaaaggagttgatatatggctgggaataggtgggggcaggagtctgctattattttgaagagctcttgacttttaaaacaatgaacatgtatttctttgagaaatataaacatcaagaaaataaatgagggctccttagctgactttacctgtgctttttggccattatttatacacagtttgttttgttcttcacatttacccccttcctgctcaatgattaaacagcgttgttggagaacatttatggaatgccatctaataacagaaatgatgtggtcatttatagataaattttgtcagcaaacatttccccatcaaaaatatagcttaatatatccattatatccttataagccatagtaaattaagatttaatgatgatgttttattagtagaataaagagttgaatagctctgtgttgattcaaatcttcctatggctttatttacacagttgtgccttccgtagtaaagtattgagttaaaaatgagtactggacctatattaagcttctacccagtgagaaggggtatggggatagggcccagttaaaataatgaaaagtgaaaagatagatgattagaatacaataactggttgaaccatttatctaaagcagagcaagaataacagtttttcatggcagtgactctaagatactccaagtttttaaaatgctttcaagtcattgcaaccaagataaactgataattatatagaacactaagttgctaagtgctttttacataagctgtcctatttaattcttgcaatatctcctcaagttggatattattaccacattcattttcagaatagaaaatagaaaacattgcagagaggttaagtagctttccaaaggttatatggttgagaagtaggataatgataacatttattgcccaagcaggatacttttgacaggcatcaaccagtggggaatctaacaacagatacaacccaagatttacctatgggacttatggcccccaattgataagagatggagcctagtccagaactcaaattcttctccaaagttgtgaactttctgctgccttgggctggtagtatcattaatgttaaacgaaattccccattagctaattataccaataaatgttgactgaatggcaattgtttttgtttgttgagagaactttcatgggaatgggcaaagcttctaaaccagtcttggggattcaggactgaattagttgcttactctcaccctagactcaccaaagtagattgaaatcttgtagagggaaggtgtctgggggtcattcaagtacaggttagaagtcctgaatagaacataataaaaggactggtagtgcaatgctggagacaagcatgtatggttaagtacgtggagcgaaattagatggcaagttgtgcaataaaccacaaagcaaaaagtttctaacaaatttgttccctgagtttcttctgctatttttctcacaagccatttttataatgttcttgctcccttttccctggcatttctggctgcccttttgggtgtattgctcactggacgtacagaatcacttttgttttcatcttacatgtttcctagggagccttcagctgaggcaactccaagctcttaattgccactgcctttttactactacagagcagaatgataggcaccttcctggcaaacagaatatgctcaatacatatttgcagaaggaaggaaggaatacagatgacgtgtttttaattttatgaaaccaaataaccccctttgaggctcaagtataaaaatctaaagaaatggcaacctacattttaaaactagctgtttacatgctcctgcttaaatgtgttttcacttttatgggtctgacagcagagccacttaggattaagtatttgatggacaggattcttagttggtcatgaatattgtcacattttcacatacaatctgccttttgacagccaaaagatggcaaaattctaccacttgtatattataaaatgggaagtatccctagcttgtgacagatccaaatgatccacttacgcgtttctgtgctgacaagtagaactctctgattgtaaacatcttttaggaaactgtaattttgtcctagtacaatacctgacatctaaaaaggcttttgtttggcttttaaaaataatcatcattacttttatattcatgcaggtgataaaatttcatatatatttctggacccttatctccttatgtttaaagcttgcattcactcttgataaattgaacattgactagctatgcactttacagctattagaatttctctttttgtctgtttcttttgaagggcttgcacttttcctgtaaagaagaatggagagtaatatagaaaattgtcactttaattttatattaatgtgttgttccccaaatagctgttaaattcaatgttcatgaattatatatgtatggaagagtcaaagcttatttccagtaagtttacttttaccacagctaagaaatgaatatctaatcatatccttctcctagtgaataaagacacctgaagaaataattacatcagaagttggaaggaaaaatgggtcctcgtaatttttctgaagcatactatgacttaatataatatttctccatcttagatagcatgagcttttaattagcaaggtggcaccctgtatggaacaactgtttctgagttgtgctgttgataattgaacaaagataactccctatcagtatctccagcagtcagagaaaaatctccaattcttccctttagcgcaagtgacttcttagaggttctactaaaattgttgtgtcaaatggcttttaacattttgcttttgagcttaagggattttatgtttttcatcaggcaagctgtgttcctgtcctgatgaaccaaatgcgaatcaaaggcagaacaatcttattgtgatttctgttactgtgtagcgttttttaaaagagatttcaggccaaaggtagtactttctcagaattctgaagctgtgttctctggcagttacgattctgtcatactttcagtatgttcacagtgtcttctgatttttgattgccaggaattcctttgtcttttgctttcttaagtttcatttggtgtgtcttgtgtatatttcatttaaaatatcctacttgttatatgttgtgcttcttgtagttgtggattcacatctttagtgacttctagaaaattcacagctgttgtcccttcaaatattgcctcttctccatttaacagctacattgagatataacttatatatcatacaattcacccgtttaaaatatacagttcaatggttttaatatgttcatggggttgtacaaccattaccacagtcaattttagattttccttacctcaaaaagaaaccttgaagccattaacagtcactcctctattcctctcaaccccatcccacactcctgctgacctaggtacccctaatttagtttttttctctatggattcgcctattctgggcatttaatacaaatggaataatataatatatggtctttggtgactggcttctttcactaagcaaaatgtctttaaggtctatgcatattgtagcatgtattagtactccattcctttttattgccaaataatattcctttgtatgaatgcatcatattttacccatttgtcagttaatggacattggagttatttccagttattggctgttatgaataatgctgccataatgctgttttgaataatcctgatcatttgtgtacaggtttttatgtggacataagtttttatttctgttgggtatataactaggaatggaattgctggatcatagggcaactgtacatttagcattttcaaaaactgttagagtgttttctacagcagctgcaccattttacatccccaccagcaaggcacgaagggttcagtttctccataccctcaccaacagttaattatttgtttagagacaaggtctgcctctgtcaccaaggctgggggtgcagtggggtgatcatagctcactgcgagtttgaactcctgggcccaagtgacccttccacctcagtctccctagtagctggaactacaggcacacgccaccttttttttttttttttttttttttttttgtagaggcagggttctcgctatattgcccaagctgttctcgaacttctgggctcaagccatctttcagcctcagccttccaaagagctgggattacaggtgtgagctgccaagcctggccacagcacttattattatcagacattttaattatagttatgttcattgggtatgaagtgtggtatctgataatcattttgatatgcagtttcctgatgacgaatgatattgaccatcttttcatgtgcttattggccatttgcacatctttggagaaatgtctactcagatactttgtccatttttaattgagctattattatttttatttagttgtaagagttctttatatattctggatatgagtcccttatcagaaatatgatttgcaaatattttctgccaacctacaaaagtaggttgtcttttaactgtgttgatggtttcctctgaagcacaagttcttaatttttataaagtccagtttatcaactttatcttttgttgctcatatttttggtatcatatctaagaagactttgtctaaattgaattcatgatcttctccattgtttgtatcaatgctttgctaccttggctgcccattaggatcacctggggagttttaaaaattcctgagtccaggccatgctccagacaaattaaatctgaatctcctgggccaggtcctaggcatcaataattttaaagttcttcaggtaattccagtgtgcaaccgaggtagagcactctgatatgcagtatctagtcaattatagtaatctgtcttttgtaagatgcatttttatgtaccagtaagaaagagaaaaatcactgtcaatcaaaatgacacaacaccttcttatcacttaggattttatacttattgaaggacaagtataacttatcttttaaagttatttagacattgattttatcatgtatcactcatgtgtatacctaacagaaaaatataagcaagatacgttcattaagatattcataaaactttcttacagtcggacttctacagtcctgaatcacttcttcctcagtcactgatttccgtgatttttcacaaagtaccttcctttgtaccatcaaaagcagtagtgatgcagaatttcttaaaagagtgttccactttgtctgtggcattttttcccaagtagttgacacctagtttgaaggttttgatgcacatgcacagaccacgagagtcacgtcctactgcctcctggccgatggtgattttgacatatattccaatttcaaagatgttaagatttttttaaaaaagtatatcttggaattgataaaattatgtagtttttttataataggaaaagggacttcgaagtatctagactagtgctactcaaagtatggcttgcaggtcagtgccattctgcaaatttgttactagtctacacgatgtaagtatagaaatttgaggtaagcacttaggaactttatgaacaattagactgagtaattagagtgagttttctccggtaatttctctggtgatgtatcagtatgttattttgtgaaaatatcagtccattatggattagacatttaaataaaaacaagactatttcttcaccaatgatagtttgaatactattgatcctagtggttctgaaattttagtgttcatcagagtcacttgacccagactgataaagcacaagttgttagccttacatagatctggggtagggtgggataatttgcatttctaacaagttgctaggtgatgccagtgctgctgatccaagtaccacactttgagaaccactgtcctagaccactataatgctggcagcagaaattttgccaacggtttccagcttaatttgtagaacacaaagtcctgatgctctcttggaaagtttcagcttccagtgatcactcttagtgaagttagaataacttctttaaaactcagtttaatctcctctccttggtgcactgttcagagcaccacaacatacagtggcataatcactgtaggctgcagagtatatgtgatcatgtttggttagatgttcacagtcttcttagaagagcaaaacatgaattttatttttcaagtgaattggtgctatgatgggtataattaagctcccagttctgagaattctgtgggcactctgttgacagcattctagagactggctgctcaagtagcacaaatatccaaggtaaccctttccagtggcataaaccaggcagcctgccagacttctgagatatttgtattggctcatcgaggtgacaggaagaagtttgtttataaaaaatcggcattgtgtatccatgacatgcttcccagaaacaaatattgttatcattgtcatcttaaagaataaagtagcccccccttatcctcagtttcactttctgtggtttcaggtgcctttggtcaaccacagtctgaaaataggtgagtatagtacaataagatattgagagagagagggagaccacattcacataacttttattacagtatattattttaattgttctattttattattagttatttttgttaatctcatactatgacaaatttataaattaaactttattgtaggtagttatgcataggaaaaataacagtatacatggggttcggtagtacttgaggtttcaggcatccactggggatcttagaatgtatcccctatggataaggatggactagaatatatatcaacctcagagaccttaataaatgacccattagggaaaaattaatatcattggatgagtcaaatatattaattattggtgccacaggcagagtaaccttccttcttgccaccatggcaaatgctgctaatcttttcagtgtccacaggcaacatctgtagccctctgaatattagatgatgcatgcctttcactgggatgggaataattaacaccctggtattgtaacctgctatgaaccttattagagtactaattcagtacttctcaaactttcatgcacctgaatcacttggagaacttgttagggggctgggatggggcctgagattctgcatttcttttaagctcctagttgatatctgtgttcctggtctgaggaccaagtgttaagtgacaggatgcgaaacacttttgaacccctgcttttgtaaggtcgcctgtctgacaaactagcaagtgggacagtggtataaccctttaccagaagcttagcccactcacccaaagtggtcattgcctgtgtctctactcagtaaaaacattcagctgacactagggatactattcgtgttggaaaccactccttttatgtctatatactttaagatatttttaccttgggcatgaaaaatgtcaaatttatttccatcagaaaatgctgtttggtgggggaagagttgtcatgagtagcatattgtgggtaattgcatagcataatatcagagaaaagcccccaaatactaaggaaagataaaagatgcagcctctgtgatatgccacttaatgatgtcctcagaaagccacagctttcccttgtaaatttcaacttatgatcaatgatcagttgtgcatgggatgagtactgctttaataaaatgataatttcattgcttcctttggtcttgggtgaaactcgagtgacgagatattattgagtctgtgtgcagtcatggctcattgtggatacttagcatgcttctattctcaaggagcacattacagtaaactaacaagaattattttaaataatgaaatctacccagatctgagggcaaatgctagattcctttcctggataaatgtcagttagcaatgcttttagctgcaaatgatagaaaatatgacttacagtgccttaaaatagggttatttttctaatacataaaaaagtctggaagttggtggctgctagcaaatgagttcaatgagttggtgatgtcaaggccagtgtctctggacttcattgccttttttgccttatggttgcagataatgtgtggaagctccagataccatgtctatgttcaaggcaggaagaagagtgaagtctgtaccagatatgtctgaacttatcagggaaacgaaagctatccaataaatctccagcaaatttctttttatgtctattgagcagaactgttacatggccatgtaagggaatctggaaagcttgcatttatctggcctaccttgaaaaatattggggtcctattagcaagaaagaagggagagattgctactgggtaggcaacaaactggtgccatgccaaaagtagctagaagtaaaatttccccgcctgatgtgattaaacttcgttcttagcagaatgcaatgatcatttctaggaaaaagagtgagtgtattggggcaggttgggagttttggtagagagaagaagcaaaggtcaaacagtattttgacatccaaactccactccctcccagtgagaaattatacatatatatatagttttgaagtaacaaactatacctgaattcaaaaggaaaggcaaacagacatcatgttatgcatgcaaagcagtttgcaaattcaacaacagaatttctaaagtcataattatggcagctccccttattctgcagtctttttagaaagttcaagtattaaacagcttgtgttgtcagcttaatgaatctctaatgattttgaaagaaaactctgtaccattaattatcattagaatgcctcttgggacacttcaagattccatttttgataagaagcaacccataaggtcttttcctaaagaatgaagcagcgtaaaacatgaacatcttggggtatagttctttaaaaaattttctttagacattgattatttgaataataaatatttctctaatgatgttagtatatatttgtttttgattttttagtcaatgttctgcatgagctaaagttaattagatttgattggagtaggattttatacatagatgagcctgggtaactgtttttgtcccctttttcatttaatcttattaaaataatttaatcactaggaggtaactcttcttttgaaattgaggaaaaatgcaattttggttggaggggtgattttttttctcttaattaaaaacagcatgtacagtcaaaatcagtcttttcaacttggttttgtaacattttgaaggtgattgccttgtttaatcctttctctgtgctttctgtttctgaattagctcatacagtttttatctgtagtctagtcaccggataaaaaggaatgatttctgtgttgtgtagattttagaatttggggagaaaagtgagataaaagacaaactttaatttagtttcactgatctaaaggaaatagaagtgttttacagattcctataggaagtctggcagggaatgtcaattgtgaaaagatataggtgggccattttcgatagatcttgaatcaagagattagttcttactagagaatcactttcctgcttccaaaagaaaatgtgaaataacttgtgccaggatctaaaagatgagcagggtcctagtgggacaatgtggtagagatatcagaaactagattttccaggagttttatgcatgcctcagagtgaatgagctgaattgacagactaggggagatgtgaacattgaagtggagtgctgtattctaacttcccattggttccactgcccctttgttgacatatttgtaagtactactccctcttttgtgtctgtacagaagttggcactttgggtcctgagcactgccagtgctgagagttctttgagagcagacccgaaacctcaaacccgaaagggtaaggagtatatcccgtcttgttttccaccatacttggtgttcaatgaattgatgaatgaatgaagaaccccactgtggttcttagacttgtgtttgtatctcattttaagatctacattctcattggcaaatcatgcctacattccactgtactttagtcaacttgtattgagagactacttggtgtgactttgaaaaattattgaaatatcttgaacttttcttttcagagcacaatgattagtggggataccttgtgcagaagaaaagggaaaaaaggtggcggggatagggaaaaagaaagaagtgttgaagttgataggcatgagcacattcaggtttaaattaactttacaagttgctgcttaagaaatatacctaaaaaatgggcagctctgctattattgggagacgaaaatattatctcacctctacaaaatgaggctgcaatattgaaacaatgccagcttccctgctgggcagcctgccgacatttcacttaggcactgaattctttctcagctactctggcatctgtgcccttcctgctgttccccactttgccaaaggctcagcctccctgagccatgtgagaatctgccctttgttgtacttgagcagagaatgttcccaacatttcatttgctcttctcctggtgagctggagaggaagagagaagcagtgtgacaactgttgtactctcaagccaaaatgtcagagctgttctgaagctaagcaccccatctttgaagtcattggcctccctccaagtctttctggctttgaaatggcagtcagatctgcatttgtcctatgaggtgctgtaagaggttctgcagtggttttagatttggagctcttgttatgagtcatctggagaactttttcagagatattccaccttgggcacatgtgtcagttattactggtgcgtaacaaacgacctcaaaactgagtggcttaggttttgttttattattattgttcgtatgtctataggtcacctgatagttctgctgagctgggtcaggcttggcttatttgggttgggtttgcacatgtgtctgcagttaggtgaaaagtcagctaacactggctggcctggcacaggctcacttatacgtttttcagctagccagctattgactggtgtgacaggggtggctcaaaatcaagagcagggatggaagcatgcaaagcctcttaagtttggaagtgttgcaccgtcacttctgcagcatttggttgaacaaagcaagtcatgcagccagttcgaacaaagcaagtcatgtagccagttcagttgtgaagggtagacaactggattccactttttgatggaaggagctacaaagtaaaatagcaaaagtcattgatgcagagagggaaagactttgtggcaggctttgcaatttttcacagcatgtggtctcagaggcagcatgaaatgagagatgcattgagatgtgtggatgtgtgttcttggtttctacatttctgtgaagtgtgagatgtgtgtgctggagaaggggaggggcagatgctgaggagtatttcacacccctctatcccctttgtcgccatcatctttcattagggctgccacaaataatcccagacagctttcttcacaggtatcatgggccatttatccttacgcctccgaagggccaatgttaggtattaaactgcagattgaggccacagtggatgtggtattattcagttatgtgcttttgctatttgttgttcttttgaaaagcaaaaaaaagatgggatagtgattatgcaaccccattattaagctattatattgttgcttttgatgtagttcccaccttaagactgaaatacaatgactcaacttctgagatttccttcttagaccaatgcaagtatacagcccacttaacaacaatgaaggtcagtggtgcacatcttcggtatattcatctcatccctgactccattttagttatcctactcttattttgatttcttattatcctcatgatggcctacaggaccctaaaagatgagcaacagcccttcctggcattacctccctgacctcatgtcctacctgtgtcccctaggcttctactgcttcatacacacaggcctccttactgttcctgaaacacaggtacactccccacttagggcctttgcatgagctgtgccctctgcctagaaagcatcacctggctgacatgctcacctccttcaggtattcaatacaatgacacctttttgacgagacctacatggaccctcttatttaatacaacacactgccacgctctcaccaaaacatctcagtcctcctcccctgctctgcattttctttttttctgaacactgatcaccttctagtatactagacagcttgttcatttataatataaattttgtattgtctgaacctcctcttcctgtgttttggagatccccaagaccaccccaggatcagtgagtcactgggagaactcaaaggactcatatggttatagccacagttatggtttattacagtggaagaacacaaagcaatatcagcaaagggagaattgaatggattgaaatactggggaaaccagcgcaggcttccaagggtcctctcccagtggactcacataggatgcacttaattcccctaccaatgggttataacaatatacatgaaatgttgtctaccagagcattctattagagactcagtatccaaggtttttattggggggtggtaacataggcaccccctgcccaaaacatatcaaaattccagactcccagaaggaaattaggtgttcagcataagtcacattgtttgcacaatttagatgcagtgagccagtcttaccagtcctgggaatggtcgtcccaaaattcaagttcccaaatgccagccaaggaccaaccttgcaagcaggcctttttaagaatagcattcccagtgctgctatgttaacacatttctctacaccatgcaggaatatcagctctttgaggacagaaatcttttgttttgttccatgatgcatcccctaaaaccagtgcctggtaggtgtgcagtaagtatttgttgaatgaatagatggaacccagacccttgagttaactgtctctatagcagaaataccacacaaaggaggaacaaactcctgatttacccccacgaggctttacctgaaccagcagtcccacgtacgtgtactcctacccagatgtctccgtgtccaaggagcctgaaacgagctcagcttccacgccctaatctgatcctgattatttcacatgtaagtctatctattcaacagtgtttcaaacacttttgatggaattatgcagcatacaagctggaaaaaattcttctcccttaagagcccatttgcttagatgcaacatgttcagaataacctagttagttgcttagtgagggtctagtcctcttcatctattttttgtcttcaccacatttgtcttttgccatccacagtgcctagcactgtgctaaataaatgcaacattgcctttaaacatttctttggactgaaaactggcttggggggatcatttgactttaccagtggctggttttgacatttatgtcagcaatttcgcagtttcttcttctaatgtttatttttaaaggcaaaagtgccaagttaaatgattcccctctcccataacatacatttccttcttctctttctacttcctgaaccatttttcattgtggctatgtaagctcttccatttacctagtatcagtgactctttaggtaaaaatctcatttttcattctctgtgccatcagtaatagaaggattaagctaatttcaaagctacttgtgtcaggatttcatccaatctggaaagtctatctgtgtcatcacaggtttgcgtgtcacattctgaagtttgacaaattgatggaatgaatcatttgttgaaattcaacaaagagcacccagcccgtgttctattctctgcttaagattaatctcagctcaatattactgaattgaatttatcagcagataaaaagaaatattttcaaaacaaatatcatagtaccagcttagaatataaatctttcataacatttgtcatcaaaattgttttaatattattgcaagaatgtgttgaaatattcctaccaatagaatatgctaggttggcatcttaataacaactctaatgctgagtcattttgtatagggagaatatttttatgaatggaagaggaattatgaatctattcttaggtcaaataaaaaataattgcacatcaaaattcctgggctgatcagatgaattaagtttctggctagctgagaaatgacaaattctgagggagataaactgtcagggtgcatttaccagcaactttaacaaatgatttggtcttgacagaaatgttttaaatacagcttctagctgtttaaggtatttagtcattttgacaagactgggttagccattcctgaaactttaaaaaatctgacatgaaaaaaatggaaccatatgccaagatattacagtacttagctagtgcttcggggggcagtgactttgttgcttcctagaactagtaaaagccttaaacaatttgtttcccaggtccttcattttatagatgagaaaaccaaagtccagagagaggggcatacagtaaactaatagcagaacacagaacagaactcaggtcttttggctttcaagtcactgtatcattgtaattcaattttatgttttaaggcagtggttctcacaatgcagcaggcatcagaatcacctggagggcttgctaatacacagattgctgggccctacctcagagtttctgtttccatgggtctgggatagagccagagaatttacatttctatcaagttcgcaaggaatagtgatggtgtggctccagtgatcacactgagaaccactggtcaaagggataggagggataggcgggaaaataagaataaatgtggaatttcctgcagaaggggaaatctttgattggagcaagtattttactaagtattagtaatcagggaatggaagggtctgttagtaagtttacttttcctattgcccttgtaattattactagataaggtttttactgttggcacaaatgcctcaggaatttcttgcctggctcagaattatgacccactggggacaatgattaattgtaaatacttcttgagaatccaaatcctcactaaaaattatcaaattgcctttactcatcttgaatattcacattaacataggaaaaaagagaaccagaaatgatgactgaaaatgaacaaaatgggtaattgagttgacaaagagaattaaacttaaaacaagaatttgattccctccgattttgtttgtctgggccagttaacaaatttattgtcagaaatgtgctttaagttttccttggtgctacagaatgggaagatttcctgatactaagattaagtctaaaaaacaaattcccactgagagtctaagcacatattttcattaacatacagtttatttccacttattttctgtttttatcttttggtcagtattcatcagctagttacattcaagtagatgctttacaatatattgagacaaaatttttaggtaaattggtgataacagccttccttcctgaagtctcctttcagcaaccttccacctgctaaaaagaaatccatatttgcctacttagatgccgtctttattgtacctttcatcctcctagagaaggaaaaaatattccttgttgatctggaggctaaactaaggttttgggagaaggggagaataaaacttaaatggcttctggagcttgagaaagcactgatgtgtaaaaggtcctgaagcagctatgagggacaaaggaggtggagaatcgggaaagggtatgaggaagtgttattgtggattaagaatggatttctgttattgtactttgaaagccaagtaaagaaagagctgctttttaattatctgtagatgctaaaagagatactgcactgagattggaccacatgggtccttgaatttattaagtttacccaaagtacctaagactcaatctctgctctaataacatttgtttcttagggggaatcaaggaaatccatggaaaattaagtttccaagaaaaccagagtggatgggataaaaaaaaacccctatatgtatagtgacacactatacatatctataaattaataaatatttacagtcacatgaaagctcttgcagttggtgagatgtgaagctttccctattgctacagcagacttagaaaagagataggggcatgcagattgaggggagaacctgagagtacaggcttcaaaaagtggaaaatatactgtgactttaaaaaatattgttttggtaaaaccctgagtcagctttccattattgggaaaccaagaggtatcagttatctactgctgcctaacaaaccacctaaaaacttagtagttcaaaataatggcaatcatttattttgctagaaaatatgcaatttggatgggatttggcaggacagtttgtctctgctccttctgttgttagccgaggggctcaacttggggctagaggaaccattttcaagatgctcattcacatgggtggcaagttggtactggctgtctgctgggaattcatctggggttagaagccttggttcttccctgtattggcctttccatgaactgattgggctttttcattgcgtggttgctgaattaagtgagcatcctaagagaatatagcaaaagtgcatgacatttcatgacctagccttggatatcataaaatgtcagataatcacacagcaatcacagtggccattgaggctcaatgggaaagagagtggcaaggtgctacaaaaacatgtggatgggcttttgtagccatttttggataatacagtctgccacaaaggggaccctaaggtatgttctatgttttcaattagtatttacaacagccaaagagatggctcagtgtttctcatcttgctcctttttctccctctgtgcccgtagatagaatgcttggcccttactacaaggccagtcccagatgcaaccctgcttttccccccatctttgttcctgaggccaattttggccacttataaacacttcaggtcacagagctgagaaggagacagtcaaaaaagaattaaataagagaagcagaagttgcaaatatttatcagtggcctttctaaccaacagtggccctccctgacacactgagagattcaccaagattagaacttcacctatagtagccaccacatttattatactgtatatagtccttattttagtttgggttcccccaaagtacatcccgagacaaggatttgggagtaagtagtttatttgacaggtgatcccaggaaacatagtgagggagtgcaaagtgagattgggcagggaggaaagccaataaaatgtgtgataataagcaggttatccccatgaacaactagggctcgagcccatggagactcttgatggatggtgtagaacacatccagagttgtcccctagaaggaattaggaaagtagagtatttatacacaaatccctgtccctcattggttgggggcatttgctctgacacttgcagcttgtcctattccagcccaaacacgctcatgaagccaaacaaaggctttaggcagattgaacaaatctttccattatctttcatatgatgcttctgggcagaccaaaacagaaagcagagtgctgattagccttctctcctcttctcctccaatgggtgtccttataccttggccatctcctctgctccgtggctgtggtgggttttttttgatcctccatcccaagctatgatttgaggtacctttgctcctttattatactccatccttgccacgaatgtaggcatagtcatcctgtcattttaaacaaggaggatagggcctgtggtccccttctggtgtggaaagtgtaaaggttccctgaatggctagggtcaaggtagcaaccagtagttatagaaaaaggatacataagggaaaggaaaggactgatatagaccagtgtttttaaagtgaagctcccaggccgccagcataactggactgcttgatgtaaatctacaccaagaagcaacatactgaggagcttcagagcataggcgttggagccagagtgccagagtttgaatctctgagctacttactagttgcatgaccttgggaaattacctgagccttctgtgcctcattttccttatctgtaaaatgcacctaggtcatatgactgttttgtggattaggtgacatagaatgtgaaatgaatgtatactgcctggcagtttctaataatgtaccttttattttattttattttattttattattttattttattttattttttgagttggagtttcgctctcgtctcccagtggtgcgatcgtacagtggcacgatctcggctcactgcaagctccgcctcccggattcaagcaattctcctgcctcagcctcccgagtagctgggactacgggcatgggccatgagtcctggctaattttttgtatttttagtagagacggggtttcaccatgttgggcaggctggtctcgaactcctgacctcaggtgatccgcccaccttggcctcccaaagtgctgggattacaggcgtaagctacaatgcctggcctattgtttttattattatttctagttcatatcctacacatagtgaatcataatctatgagaatggaacctggaaatctgcatttctaaccccccttccccatgtgatttatatgtatcctgaagtttgaacaccagtgcttcaagctgagagcccaggagagagatcaggtgatgtcaagacaggattgtttaacatagtaacatctcatttccccagcaactttgggaaattaggagtttcttataagtgagttctccagatggctgagactgttctctttaaacactcaatctcaaaagttaacacttgatgtattatgcttaactgtaaacgatatatcacatgcttacacagagaattctggaaagtagtattataacaatatttttggagtgacttagttatcatcagacagccaggcagatggtaagtatttattgactgtctcactctgtcccctcgttttggtaggtgctgaagatacaaagatgaacaggaccaaatccctgctttcaagagtttcactgtctagtagaaaagagatcaggaaatgttgacacagtgagagaagtgatagaatagaaggctgttttgagctttattacagggaattcctaacagctataaaagtgggaaggatatgttaccctgatgttgagccccctgagtgcttgggcctgctatcttatagctactatgtctctcccttgctgtcaattgacactccctgtttctatcaatttttctgccttcaaaggacattcccatcctcatctactgtgcttcctttattctgctgtggtctggaaaccagataccctgaacttgatgagaggttgccgtcttagaaaggccttctctgaccttgctatctaaagtagcatgccccaactccacacacaaactctgcatctccttaccctgcttgatttttctttatggcctttagtactacctgacatcatgttacatatgtttgtttatgttccatggtctactttcttcattggaatgtaagtgtcaaggaggcaggggctctgttgtttagcacacctcagtatctagcacctaggacatggcctggctcagggttggcttctaataaatatttattggatgagttataatagtagcaaataagtttctttttaaattttttattgaggtatagcttgcatatagtaaagtgcacccatcttaagtattcaactcaataaatattggttaaatgtgcatactttataaaccacactcagacaaagatatgcagcatttccagcacctaaccagcaggctccttcaaacaatgcccatacaggacctcctccaaaagataactactcttgtgacttctatcataattgattagttttggtgatttttgaatttcatataaatgggatcatgtagtttgtgctcttgtatgttagccttttcaacattatgtctgtgttgtgtgaagcagcagttcatgccttattgcttgtaatattcattgcatttactgcagtatgtttagtccattctactcacatgtgtgttgtttctaggttttggtgttttagaaaatgagctttgagaaagtccgtgaaaggtgccatgagtagagggcatggattcgatagcaactattctgtgtgcttttcctcattaccccattttatcagtcctacatttctcgaactgtcccctttcttcctgctacttcagggttctgatttatgcttggacctgggatgtctctctggaactaagtcaaatttacaaaacccctagttggactagtgttgtagtaaacccacattcctgccagttcatcccaggacacccaggacacagaagcagaatgctgattagctttctctttggatatcctctcttttacttcctcttttgtccttggttcttgtttgctttctgctaattccctccactaactgggggcacctttgggcctaatgtgttttatagccatgattctcaatcatggctgcacattataatcacttggggaacgtaaaaaaaatacccatgcctgggccccactccaaggcaattaaatcaacatctctgggggtgggacctgggtattagtatttctgaaaaactgttcaagagattttaatgggcagccaaatttgagcaccactgcgggacacattttgttttaggaaatagtgcagatgtgtagaatcaactcacttctttcccccggcatcaggcacaaccaatttgtttccacacaacttaccagatgagactcttgaatgttgtcaactttataaatcttagggagcgatttatatgagaactgcttaaaaacaaggatgtcaaaggaagcggctttttcttctaccatggttgtcactctatggtgtcaagagaagtgttagttgaaatttggctcatgaattacaatttagatcaaactccaagctgtggcagggatgtcttgactagcattgagtggatacttctgaaagacttgtgatttttaaaaacatgtgtaccacatataagcacaattagcactactaggttacaagtgtaataaggccagggtccattttataataatctttttcctgacaacattcaacaccattttgtgtactgcaactaacatttactgagtactttctgttatttactactcagcatttacaactcaatcctcactattataccagctgtcttactgagcacttatgtgttatgccctgttctaagctctttaaagatattcattcatttacttttctcagcaaccctatgagttgggtttttattattatccccattttacggtgaagaaactgaggcacaaattggttaagtaccatgccaaggcctcacagatggtaaattgtagagctaggattcacgcagtttggcctcagagcctgctcccttatcatctaccctgtgcttctaaaattttaatgcgcgtagaagtccccaggggattttgttaaaatttggattctaattcagtagatctgggatggggcctaggagtctgcatttctaacaagctcccaggtggtgttgatgctacagatttatggaccacattttgagaggcaagaacataacttatgagataatttctattattgttcccattttcaggtaagtactctgaagctcaaagaggatagtggtattaccagcttctcatagcaaatatacagtgaagctgtaattagaattcctgcagttgggtgtcaagtgtgattgcctaactgctctgcttaggtgcttggtaaatggctattgaatgataactaaactgatattcagtttactgctgggtctaacagatggctattatatagtcaaaggttggaatgtattgaatagaactcaaataattatatgccttccgtctgttctttttacaccttggaaatgaatctagtatcaattttcatctttaccacattttcttctcatagcctaagcaggttgttccacccttgctgttagcagggaacacaaaggaaacaactcagcaagttttcgttgaggatatctttctgtgggcctgtttaccattgcctttgcttttgaaaaaatagcacagaactggaatcctgctgatataaatatttctcattaaattgtctgaatagcgatcccagtagatatagaagcaatattattcaaaataattaaaaaataatgccactatttaaggttttgcaaaaatattattttccacttttgtacaaaaggaaatattttcatcagtagccttgactcacactcagtgcaattttgtggtggatgagattcaggctcccattccccattgtgtcctaataccatggatttcctccatgaagggtctcctgagaacaaggcccatcagagatcaaaacaagaatcaaatttagtgttctctataacaattcaaccattaatgttccaggaagaactctctatccactcctaccactctgaaatattttccaaccagataatgcatatatatatgtgacaaagagcctttgcctggaagaaaatttatttacttattagattattttaagaggcacttcttggctcagagaactggagggaacaaaatatataatataaaatatgtggctcataaaaatatgtgacttcacacaaccaaaatcaggggcgaaatgctagcatctctacattgtaatggggtccagtgttaaaaaaggactcttggctggattttattgactagcattctaaagttgttactttctctgcagaaatgtcagggaggtactagcttgtctcatttatcactgatgggaataataaacctgactagaagatcagtgactgtattcactcattcatacattcagttcctaaataaagattgttgagcatcactatgctaggaacttgaggtaacaaggagaatagcatatggtttctgccctcagggagttcacaaaattactagggatataatacaaacaggaacaaggttaacagtaggagatggtatgtgacaaggataatacaaatggtacacagtttcttagagtagtgttttatcagagtggtccctgggccagcacatcagtatcatctagggacttgtttgatattcagattcttgggccatacctcagacccactgaatctgaacctttgtggatggaccccagcggtctgacttttaacaagatcctaaggtgatttgtatgtacattaaaacttaaaagtgctcttttgaaagatcacttctatcagaggaagaacaacacattaaggtcttgtccttgagagcttataactcaaaaaaatgacatttgaatgtgaataatcaaatctgataagaaacactcacacatgtgactataggaacaaggaaaagtgggtgggggggagggagagagagagagattgactgatttaaccctgtggtagttggagagactggtgaatgtttcctggaggggccgttggaggatgaagaaatgctgtcagtttgaagtgcatttggctgtaacagaaaacctgactgagagtgatttaaagaagaagggtttttgtttctcacataagtagcctggaggtaggcagtctccagcgctgattcagttatttaaggatgccagggttctgggtcagcgtctccttagacctcttgctttctgccttatgatcaatcataagatggctgctgtagctctgaaaatcacattctcatccaaccatattcaaatgcaagaagcagataggcatagcacaaaaagatccctcttctgcattcttatcaaggtggcaactcttttctagaggcctcccagcaaatctccactatgtctgatttactagaactagaacataagactaccagtataccagggtctgttcaactttccatgacttctagtaatctcagcccaatattccaggaggatagagctgctgttagcagggagcaagtgcgtttcagtgggaaagcttttgagtaagccaccaacagcctatagccaggaagactagagtagatggaatcaggagtaagggcatttccccaaagagggaaaggcatgaatgaaggcatggaggtgaagtgtgcatgaagaatgattactagatgagtttggctaaagcatatgagtcttacaaaggaatttttagccattaaaaaaaatctgtggaaccttttgttcaattggaatcatgtgcagaaacccaattcacagaggaaagcatacctgcttcagtcagaagtagggtgggatgcctggagccagcctgctctgtctctgacctacttcagctgaaagggcttcttgaaagccaaactgaagaacaatgtcccagaaactgctactttgaccctgccacacccaagattctctgggcccctctccctgcaggaggccacaaggcattcatcaaggtccctcatttggccccaaactggagcttcacaggtatgtatggaaatataataatccaggctaggggtacctgtgtatgcgtttttgtggtgttgctttttgcagataccacatgtgaccctgtgtctcttaattccattcctgacactgaattgctaaaacagtagttgaggagagcattgtggtaaaacaactagaggaaggggaacactattagtggtgattagtggcttgcctcttcacttcctgcccttacaaccctgtgttagtttcctagtgtggtcataacaaagtaccatggattaggtggtttaaacatcagaaatgtattatctcacagttctgaaggccagatgtcagatcaaagtgttggcagggttggtccctcctgagggctgtaaggggaatctgttttatgccccttccataacttctgatggtttgctagcagtctttgatattccttggcttgtagatctctgccttcatcttcatatgacgtattccctgtatgccttcacattgtcttccctgtgtgcatgactgtctttgtgttcagatgtccccattttataagacacagtcatattggattaaaacccaccctgatgacttcatcttaacttgatcatctgttttcgaataaagttatattcacaagtactagaggttaggacttcatctctgtttggagagacacaattcaaccagggaattgtggaagatggcaatgaagatttatcccatcttcattcaacccctaacacatcctatatttcaaacctttgcttccctttttctaaggccttctcctctcactcttaatcctagtggctatgctccagttgtttaactcttgttatggtggaattgagtgggaaagatgggttatttcaaggaatgtttcatcctcactattctgtttgaagacataattgtgtagaataatgtttgaaaataaacactggcactcaattatattaattcaagattgaattataattcaatcttgtgcatgggatcctaagtttgaataaaaaagtgcagaatcaaaagaccaaataaaaattatcacaattattaccaacattaccttgtatagcactttcgcacagattatcatttgaaagcatattcttttctaccagcaatcaagatccccttttcacatctacttttgcttgacaataaattctccttgaggatgtttcctgacaggattgtctgcggaaaatcctttacttagagttgtaaccagaatcttcctaaatttagcagagttcatacaacactgagctgaaacccaagtaagggagatggacagagacaataaatgagacactgaagaaatataaaatggaatttaaaaactgtaaattttaggggggtaagggcacttacaaaagtggggttaaagaaccaagttatttttagattatgtggtcctaatttggcagcatactttattattaaattttgaaacttgctaatgaaatactagttcttagtgacaaaatctgcccttgatcaaggaagcaaaaaggagaagttactccgcaggtatcagtctctccactttcttacattcaattctgttgtcaaatgttaagactgtttcctctcattcagtggaaatttccttcagcttatttttcctggaaatggaaaacagctgcgcagagccttcattcaaccctctactcaaaggctcttatttgcatcatcaactatttgcttttctctatcccaatctatcaataaactaagttcacatctcttcttcagagcatttttctccctcagtgtggatgccccatcctcataaaagcatgacacttagtcattgtttatactgtcattcctacctagaaacgtctttccctcttaatttttttggaaaaatgtaccccatcttccttcaagacttagccagggagagagctctggagcacatttgggaaggcatgaaatggggaagcccccaggaaggaaggtagacaaatcctcaggggacacagcctggttttctcctctgtgtagactcctaatgtgccattcccaagatgctcctcaatattgacgagtggggttttctggaactgtacattcctaagagccagttgacttctagagtgaaatacagaatgtgggaatctccagagaaagaaagcccaaggcaaaagagtaagtaactcttagagtctcagacatggaaagataactggtaacacttggctgctggagaatgaaacccctcctaaaggcagatattcaggcctgtgatagaatcattgaatttcatctacctagttcccatcaggcctggggaaatggggataagctgcagagtctacatggtcttacagaagctgaagcaagttgcagagaaatttcaaggacttttaagtccagtataccttggatttggggcactactccagcacaaattcctccctgcttcatgcagattttcattgccgatggccccacttccagaaccagaaattccaacattcctatggcggtcttactttccgttgccccaggaagcagaaatggggacaagactgcaagactgaccatgagaccatggcctggactgaggggctcagctactttcttaagtaccttcagaccagagataacagctgtttggaacatataaatgagaccttgtctctggaacaatcatctggctttggttattcattatcattgaaccccacatgcctcacttagaaagatgtcccttccaaagctcagaggccctcaccatcgcatgcatgctcctctcctagtacacttctggagtggcctgaagagctggagaagtgggcactcagctcacatctcaacccagatctccacagatcacatccttgtttctgtcacatcagtagtcagtagtgcccccatctcatttatatccaaattaagaacatcttaatatgagatttcatcctttccagattgacccatctggatttggatatctcagtaacaagatactttgtcctttttcatcattacttagctcctcagtttgcaatatttgtgtgtccctattattcttgtccagttatacaagccttgaggtaatgcactgtcttttattagtttttcagactccacacagagattgacacagcactggcagaacacatagataccattgcttaataagaaaattcaagatacttggttgattctgaaggacatcacttctgggatcctgagctacaggcattaagcttaaggaaaacctggttgaagatcatctttatggtgaaaataagtgttggtggatcaatagcaacccattacagatattttcacattcactgaaataaaactttaaaagtggcactctaactaaagagaatatcaataacattttatcactttaatatttggttacttttttctattttcctcagctcactgctatttcaatgaaatgatttgttttgctttgttgaagaaaatattcattagttaaaagataattttggactatgtctggttgtatgtccaaatattcggtctttctgattttatgagatagttgaccctgaactccaagtggcccaccttagttaatcaccatattccagggatgtgaaggaacttggaagcttgaaatggaataagctgcattggagccagttgcactcagcccccttccccttggctggtggtatccctttggccctgcttcatggctttaggccaaattgcctcctgtcagcatccctcatacacctctccctggtgccgcgtgaggatagttcacagttctgtggcctgggatgactctcatcttccttcatctttcccaagacattattgccaaacactctcctcctctaccattgttttacctcctaatcctcaggtctctttttttctaagaaccacccccgtcccctgagattgttcccttcaacttgacatttccctggaatcacaattcttatagtggtaaaaaggtgtcagaattatatgtacatgaaaggaactcaagttggagagaaacttggatacccataaaggaaagtttccaatgctttcatgtcaatactttagctcattttacaacccaccgcctatatatcttgtgcaagtcattttctttctttggaatcaataagggttccctgtgtcttctctggcatttcccaaacagggttgtcatgataatggagattgtgcaaaaagagggacttactatcaaatactttttttttttttgcaaactctatcccactcttagagattcatactacactgagaaatcctacactgaaaaaaaaatttttttaactttcccaagtatttaaccacaggagcctccccaccgtttcccttatactaatcatctgttatcatctggtagcacaaaattttgtaaatgcatgagtaatacatgaattgcacacttcttcatgtcttttgagcctgctgcaaactgaactgagcttctctattcaacctgaatgttatctttttctccttcacaacatgatatgttattgcactggtgtctatttgatcaatttgctggtggtccatcagtaggcctttgctaatgctgttttccccacctggatgttcttacttttaggtacagcttatgttctaaatcccttctccaactgcctatactctgtctccattactgtaccagattaagacctacttttgtccttacaactgtacattcccataagacatggctatatcacatccaactgcactatttctccttagctccttttgaggatataagaaattcactaaacaccacttcattgattgatggattatgaggatattatttcaactgtacaattggcaccttttcataggcagtttttctacattgagtgcagggtcattttttgttgttgtttgttttttgtttttagctaggtacagttcagttcttacctaagaatacaactatcctgcattcaccaccatgaaagccagtgcacttatttccactttattttaaggagagcatgaatgttgtggatttatttactttttctaatttaagagaactggccactttgaaattttatagtgtctcagtgcctgagaaacacttaattctcctgaaccagctataacataggtgtaaattgatggtattgtcccttcagcctttctgtagtagaagatgcaccaagataatgtagacattatctttgctgtgtcctcagagttatgtaaataaccctacttcccttcctagctgaaaaactgtcattagtttgtgtttcaggtcattctctgtctactgaatgaaattcaatagtccttgaaaattcagccttccccaatctaatcactacatcattgttttaaaaagtgattcttttaaaagcattgatttttaaaggctattagtttttgtttttgtttgctttttaaaatacttttagtactgttcaattatttattatatgatttatttttattaactagaattcattttttaaagtattgcatgtacttggtaaaaacaaaaataaaaacacatccaagtgtacaaaagagtatataaaatgagagctaagtctttctctcacctcagattcccagtatccagttctcattcccacaagcaaccaattttacatgtttgtgaatctttccaggaatatcctaaacatatccatgagcatgcatatgtgaatggaacatgctatgcatactgtatataacctgttttttatttgacattatatgttgtgtagctttctatatcaatacatatagatctgccttattgctttcatggttgaatggtatttcattgtatatagatgtaccacacttcatttaactagtaccctagtaacagacattttagttgtttccagtcttgccattgaatataacactgcagtgagttatacatacatctttgtatatctgggaaaatatttattggaattaagacaattttttatcaatgttgccaaattgccttccaaagaggtagcgcctgttgacctctctcaacggtgtatgagagtgcctgtttccccacaaatcgcctgtgctataaattttacttacccatttcttccactctgcaagattaaaaatggtagctcattttaatttgcatttctcaaattaggaatgaagataatctttgcatatgttttaagtcttttgcatattattgtatgcaaatttcttgttcatgtcctttcccatttttcccattgaattgttgctctttttctaactactttgtaaaatttaaaatattaatatcatgttatgtattttgctaacatatataaaatcattcctctgtgttttgttctactgtaacttttatgattacttttttgatgtttaaatattttgtccatctggaaattaatttattaaattaatgtaaaaataacacaatttaaatcactgtaagttccatgaaaacagaggccaagattctttcattagccattgtatacctagtgtcagacacatttatttagtactaattgtggccaaaatataatgggtagcacatttccgggattttctttgctcttcttatctgcctcctctaagaagcttctctgacctgacgttctgaggaataagaggtcataccaccgtttactgaaacatcagcagttggttggcagtggtggatgtgacagtagtgatcagggagtcaacactgctcctggccttcactgcttcctcctcaagatgctcagagccttgagtaaccccaataagtgtatcagctcacattcaccactttcatggcacccccttgtgagatttagccacttttcaactgcctgtgtatagaagaaaacccacactattgtatcctggtcaggctgcgggcactagggagaaggggaagttatagaagactctttggagagctcattgactatggcagctaccatgcagtaccatgtggtgacactcctgggtggttacaaattgaagctcacctgtatcactagtttggaatagggctggatgaacttcaaaacactgttttagttagttatatttaaatacctaacaaatatccctaaatctcagtgtattacaacaacaaaaagtttttatttttcctcactcatggggcatctctgtgtggattcagcttggctgcatgtgtgtctgtcctgttcttcttggactgtcagttacccaaagcatcttctttttacagaaattgcagaagttccaaaggaccagccaaaaccataccaccatattgagctcacaaatgccaagttgaagggacctcctggtagcttctgcgtacccataatagaacacaacacagggtactgataaagataatggattttggagcctcacaacactggaatggcagacactgttatctctccttcttccatggtgatggatcctagtccccagagtcgagactcacaatgtcagatacttctccatccttccttgctgctgtaggtagccatgttacacggttctggctaaagagatatcaggagagctcttccaggtgtccttgaaattttttttttttcctgtttgagcaagctacttttcagtacctcagtgttctcatctgcaaatttgggctaggtataatgtacagaggtgttgtactagtcaattcttgctttgtaacaatccaaaatctcaatggttttcaataacaaatactgatttttttgccaataggtctgcaggtcatctgggattgctctgcttcaggctgtatgcagggttcaactctatatgtttcaagacaagacaaactatgcaagcttttgcttatatcactaacattcctttgatcaaagcaattcacatggccaagaccattaatagggcacagaaatatgcttcagccacaatggaaagcagtacagttacatggcaaagatgtggatatataatcctattacaatagaatgaagactgaacaatattccattccatcttctcacttctcacgcttcctaggtgtgtagacataagcaagctactagcttctcagaaacttagtttcctcatcctcaagatggcagtgggcccttttctctgagttggtgtaaagatagacagaaatcatttgccataggagacccttaacaaaagttagctcttcactcccacaactcagttctgattgtttactatctaagcttctcccagaagataggtgtgtgatttaatattggcattccatgagttgatgagtgaatgaggtcaccaatatgacagctccctgagggaggaagcaaaccatttattcactaagcaagtattgagcacctgaaatcattatttcaaggtcattgtcatgctttttcatgcttcaataactggaatttttttctttttttggcagatgacccttaactcactctgacaagatcatatgaacactgatattttaagactgattttgactgctttataggctccttctactggagtaaaatggtatcttttttttcctgaagacttcaagatagtttcactttaatcaaaagcaaatgcagtaaacaatttgctgcattgctagactgccttttcatatagtgtttctgctgccatgtcccaaatttacctgtcacagagctataatactgactggtacttctttttaaaacagagctttaccaaaggcactgattttaaagaatggtccaggaatgtgaattaataataagcagcttcttgttccctgtgagtaacgcccttgttacttcaattctaaccttctcagttttagaacatctgtgagtattatgggaaggctgtgttggacctatttagaggtgcttgctaagaggaaatgatctctagtcaccaggtttgctatgttatgtaggtagactatgattttctatagaaaaaatgaggatggatgcaaagccaacacttctttgccagggagagccatcctttcttggggcatacacattgtcaaggctgtcaaaatgagatttcttgtgaatcttttaaataaagccattattcattgtttaatgcttatggagtttctctttatttctggctcggcagtatgccatatatgtctccttctttcccacctcttcacctttttggagtcactttttctatttaaattacatagtaggatatttcagcgagatctgaactgattgattaaaagaagcttctatgtgatagtgtagaatagaggagaatctcacagtaatgctgactccagggtatgtgaggtagtggtaacacctccagtcctgccatagccaaaaacagtgttctcctacagctttgaaactcaaaggatgctctgaatcagcatcccctggcatcacctggggacttacagatgcagaatctcaggcctcacagcacacctactgactctgtactttaacaagattgccagggaatcagcatgtacattacaatgtgggaaatactggtctagagtaagaggaaagcacacagtaatgccaacactgaggtattggcattactcagtgagagagtgctagcacctcagaatctgtcatagccaggaacagcttactcctgtattccactgaggtctatgattaacacccatgggcccagggccagctccacccattagctttataacagtgggcagtaagcccacaacctctgccctgaaatcagtgctcagtatctttgttgactggtacttcctgattttgacctcatggaccctgacctcttgcacctaccaatctatgttccactgacttggctgatttagctgactaccatagtacgtttaatttattagctggtgatctttgtcaaactcctgtgttctagaccttcccagcttgaatgtaaccaggcttaatgtaaccacaccttactgttgagatagtgttaaaagagcctgtgggtctttaacagctaaatccttaaattagtcataactttttcaattttaggcaatagaaattcaacttgaaataacataattttaaaagagggggcaccagtatgggtcaaatatcatgtctctctaaatatgatgttctgcaaaggacaggacatcacttttgagattttcctgccccaaatgcgtaaggtaactttaatcatgaggaacatcatacacatccaaattgagggacatcttgtaaaataaattgcctgtactcttcgaaaatttgtcaagaaagagaaaggctcagaactatcctacattaatgaagtataaagggaagtgacaattaaatgtaatgtgtgatttttttcaacttgatgttttttttattattattatactttaagatttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccctttcctgtgtccatgtgttctcattgttcaattcccacctatgagtgagaacatgtggtgtttggttttttgtccctgcgatagtttactgagaatgacgatttctaatttcatccatgtccctacaaaggatatgaactcatcattttttatggctgcatagtattccatggtgtatatgtaccacattttcttaatccagtctatcattgttggacatttgggttggttccaagtctttgctattgtgaatagtgctgcaataaacatacgtgtgcatgtgtcgttatagcagcatgatttatagtcctttgggtgtatgcccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgggcattttttcatgtgttttttggctgcataaatgtcttcttttgagaagtgtctgttcatgtccttcgcccactttttgatggggttgtttgtttttttcttgtaaatttgtttgagttcactgtagattctggatattagccctttgtcagatgagtaggttgcgaaaattttctcccattttgtaggttgcctgttcactctgatggtagtttcttttgctgtgcagaagctctcttgtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcacagcaccatttattaaatagggaatcctttccccattgcttatttttgtcaggtttgtcaaagatcagatagttgtagatatgtggtgttatttctgagggctctgttctgttccattgatctagatctctgttttggtaccagtaccatgctgttttggttgctgtagccttgtagtatagtttgaagtcaggtagcgtgatgcctccagctttgttcttttggcttaggattgacttggcgatgcgggctcttttttggttccatatgaactttaaagtagtttttttccaattctgtgaagaaagtcattggtagcttgatggggatggcattgaatctataaattaccttgggcagtatggccattttcacgatattgattcttcctgcccatgagcatggaatattcttccatttctttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgcctgttattggtgtataagaatgcttgtggtatttgtacactgattttgtatcttgagactttgctaaagttgcttatcagcttaaggagattttgggctgagacgatggggttttctagatatataatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgtgtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttacatgctggattacatttattgatttgcgtatattgaaccagccttgcatcccagggatgaagcccacttgatcatggtggataagctttttgatgtgctgctggattcggtttgccagtattttattgaagatttttgcatcaatgttcatcaaggatattggtctaaaattctcttttttggttgtgtctctgcccggctttggtatcaggatgatgctggcctcataaaatgagttaaggaggattccctctttttctattgattggaatagtttcagaaggaatggtaccagctcctccttgtacctctggtagaattcggctgtgaatccatctggtcctggactctttttcgttggtaagctattgattattgccagaatttcagatcctgttattgttctattcagagattcaatttcttcctggtttattgttgggagggtgtatgtgtcgagaaatttatccatttcttctagattttctagtttatttgtgtagaggtgtttatagtattctctgatggtagtttgtatttctgtgggattggtggtgatatcccctatatcattttttgttgtgtctatttgattcttctctcctttcttctttattaatcttgctagcagtctatcaattttgttgatcttttcaaaaaactagctcctggattcattgattttttgaagggttttttgtgtctctatttccttcagttctgctctgatcttagttatttcttgccttctgctagcttttgaatgtgtttgctcttgcttttctagttctttttattgtgatgttagggtgtcaattttggatctttcctgctttctcttgtgggcatttagtcctcgaaatttccctctacacactgctttgaatgtgtcccagagattcttgtatgttgtgtctttgttctcgttggtttcaaagaatatctttatttctgccttcattttgttatgtacccagtagtcattcaggagcaggttgttcagtttccatgtagttgagcggttttgagtgagtttcttaatcctgagttccagtttgattgcactgtggtctgagagacagtttgttataatttctgttcttttacatttgctgaggagagctttacttccaactatgtggtcaattttggaataggtgtggtgtggtgctgaaaaaaaatgtctattctgttgatttggggtggagagttctgtagatgtctattaggtctgcttggtgcagagctgagttcaattcctgggtatccttgttaactttctgtctcattgatctgtctaatgttgacagtggggtgttaaagtctcccattattattgtgtgggagtgtaagtctctttgtaggtcactcaggacttgctttatgaatctgggtgctcctgtattggttgcatatatatttaggatagttagctcttcttgttgaattgatccgtttaccattatgtaatgcccttctttgtctcttttgatctttgttggtttaaagtgtgttttatcagagactaggattgcaacccctgcctttttttattttccatttgcttggtagatcttcctccatccttttattttgagcctatgtgtgtctctgcatgtgagatgggtttcctgaatacagcactgtgatgggtcttgactctttatccaatttgccagtctgtgtcttttaattggagcatttagtccatttacatttaaagttaatattgttatgtgtgaatttgatcctgtcattgtgatgttagctggttattttgctcgttagttgatgcagtttcttcctagtgtcgatggtctttacaatttggcatgattttgcagtggctggtgccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttgtctttaagaatgttgaatattggcccccactctcttctggcttgtagagtttctgccaagagatcagctgttagtttgatgggcttccctttgtgggtaacccgacctttctctctggctgcccttaacattttttccttcatttcaactttggtgaatctgacaattatgtgtcttggagttgctcttctcgaggagtatctttgtggcattctctgtattttctgaatctgaatgttggcctgccttgctagattggggaagttctcctggataatatcctgcagattgttttccaacttggttccattctccccgtcactttcaggtacaccaatcagatgtagatttggtcttttcacatagtccgatatttcttggaggctttgttcgtttttttttttttattcttttttctctaaacttcccttctcacttcatttcattcatttcatcttccatcactgataccctttcttccagttgatcgcatcggttcctgaggcttctgcattcttcacttagttctcgagccttggctttcagctccggttattctagttatacattcgtctaaatttttttcaaagtttttaacttctttgcctttggtttgaatttcttcctgtagctcggggtagtttgatcatctgaagccttcttctctcacctcgtcaaagtcattctccatccagctttgttccattgctggtgaggaactgtgttcctttggaggaggagaggcgctctgctttttagagtttccagtttttccgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagtggattttcgtgaaccgcaaatgctgctgtctgatcgttcctctggaagttttgtctcagaggcgtacccggccatgtgagaagtcagtctgcccctgctgggggggtgcctcccagttaggctgctcgggggtcaggagtcagggacccacttgaggaggcagtctccccattctcagatctccagctgtgtgctgggagaaccactgctctcttcaaagctgtcagacagggacatttaagtcggcagaggttactgctgtctttttgtttgtctgtaccctgcccccagaggtggagcctacagaggcaggcaggcctccttgagctgtggtgggctccacccagttcgagcttccgggctcctttgtttacctaagcaagcctgggcaatggcgggcgcccctcccccagcctcactgccgccttgcagtttggtctcagactgctgtgctagcaatcagcaagactccgtggacgtaggacccttcgagacaggtgcaggatataatctcctggtgcgccgttttttaagcccgttggaaaagcgcagtattagggtgggagtgacccaattttccgattttccaggtgccgtctgttacccctttctttgactaggaaagagaactccctgaccccttgcgcttcctgagtgaggcaatgcctcgccctgcttcggctcgcacatggtgcgctgcacccactgtcctgcgcccactgtctggcactccctagtgagatgaacccggtacctcagatggaaatgcagaaatcacccatcttctgcgtcgctcgcgctgggagctgtagaccggagctgttcctgttcagccatcttggctgtcccctttgtaatgtgtgattttggattggttcctgtgacagaaaataaaatagctgtaagagatattattgggattattggaaaaatttaaatatagactagattagataatagtattgcataagtattagatttactgattttgataattgtactgtagttaggtaggagaatgtccatgtttataggaaatatatactgaagtatttctggataaagaggcatcatgtctgcaacttactccaaaacacctttcctccccaaatagaatgattgagcaaatgtggcaaaatgtgaacagaatattaccatgggtaaatggtatatgagaatttttgtactattcttaaaactctatggaattatatacaaaaattataggaataaaaataaattcaaagggatgttattactagatactgggaaacctcacagaattaaaaaaaaaagagcgacataagactcagggcagcatggaaaccttgaaaactggaagtgaaaacttgatgccactggaacaattctgatctggacagacttctttgacagagataatagaaacctggaactttagagcaagaaaagacttttaagatccgtttcatgaatgagaaaactgacatccagacagctaaagtaacttgcccaaagataatgaatatagtttccacttgcagacatttaagattccttttcctgttgatttttgaatggatacccaaagtttgttctctttcttacacttttaagttagaatatgagatgaagtaaggacaaaattaacaaataatgataaatatgctgtaacatgaatatatattctgtaaacaaatatctaaacatttccccacacacaattaacatgttctccccccaaattttgtccttatatgtgtataataaaatatttaaacattaaaaaccataggtaagcatagtctttttgtatcatttaacacacctgtccctatccccaccttccccttcccctttccaacctctagtatcctctgttctactttttatttttatgagatcaacttttttattatatagtttgagatagctagaaagaggatttcgaacattcccaacaaaagaaatcacaaatgtttgagatgatggatgctaattaccctgatctgataactatatttaatatatatatataaacacatcactatgtaccctatgaatatgtatagttattacttaatttttttttaacttttagcttcaagggtacatgtgtaggtttgctacataggtaaattgtgtgtcacggggggtttggtgtacagattatttcatcacccaggtaataagcaatagtattcaataggtaggtttttgatcctcactcttctccctcccccaccctcaagtaggccccagtgtctattgtttctttctttgcatccatgtgtactcagtgtttagctcccacttataagtgagaatatgcagtatttggttttctgttcctgtgctagttcacttaggataatggatagagcctccagctccattcatgctgctgaaaaggacatgatctcattcttttcatggctgcatagtattccatggtgtatatgtactacatttcctttatccagtctaccattgatgggcatttagtttgattccatgtgtttgctattgtgaatagtgctgtgatggacatacatgtgcatgtgtctttatgatagaatgatatctattcctttgggtatatacccaataatggacttgctgggtcaaatggtggttcgttttaagttctctgagaagtcaccaaactgctttccacagtggctgaagtaatttacattcctacaagccatgtataagcattcccctttctctgcaacctcaccagcatctgttagaaaaaataactttttaaaaagcttgcgtaattgtctttcatgacaatcttatatgaaagtcagctagaaatttgaatttcttcgcttattatatgggtaagtacagtctgtcctcttccatgacatttttctcacctcgtagaatacattgactctcaattgaaaaacaatgctaatctagacaattcttagaaatgtccctcatgatgtggagtgactatgattgcagtccatttagaaagtataatatcaagcatggggggtgcctagaagccatctagtctgtctattccttttaaaggtgaagactgtttgcacttggttacttaaacactttcttcatctcttgcacctgtttcatagtaaggaacagattttaaatggaatattatctatttgcatatattgaaataatagttatctttagatcacttctgaagtagtatatttagagaaagccaagcatcctctaagcatgctttctacagttctatattacttttggtttagaaaaggcctttgtgtagtgattagacagttatattcagagctgagaaagcagccttgaccaattatctccacaacagctttggaaatagaatgcaaatcctagccaaaggatcctaggtggtggagcacaaaattgaatatatagtgacatagtgtgtggcaagaagcagtgcatttttgaaaaaggaattaagtgtgccttccatcatctgtgttcagacatgatcatgaatggctaacataaattttcagacaatatggattcctatagttcagtgtggtgacggacactattgccgaccagagctctttttgccacattgtccttactaatataaccctacttttatttgacatagcgatttttgccaataattgcttgatttttcagcttttctttctgtcaggtttgccatgtcatataacactagctaatgacatgtcagtgtaaatatgctagggtattctgggaaaccttttggtttcctgataaaagagaatacatgcgcgtggccccttcctcccatttcttcccaccttgaatgtaaacatggtgtctggagttggcagcagccattttgtgcctatagtccaccatgaagtaaggaagtgcaaattgtgtcatcctggctctgacatcacaagtcactaagcaatatcagcagtcagccagtttcagactttttgttacatgagaaaaatgacctgttgtttgattaagccactagaagtgagattttctattcatttaagttaaatacattcctgatacaaatagagtagacccttctgggaatgtctgcctagctcagaataaccccatttctctgtgaagtttcgtcctacttctcctctcggtggatcattgcagccatcttgaattagttggccctgctccttcagctagagtggatgccattgtgtaaacacacctgaatgaggctgaacctgaatgaggctgaatgtatcagattctcctaggaatttaaaattgggtttcagtaactctatttgatcctgtaatgtgactaaaacttagggatatgtttaaacttggaatgagagagagagagagaaagaaagagagagataatatgatgggaggtcaccttcagccacagaaaagtagagaaagaagacttgtagaaagtgaaagagaggcagagacccatgtcaccaagagagagaacactggctacagcctggaggatttctgggtccaagcattggttccttcttggtcctagctgccctcaggtttcaggagctgactcagctttcttccagatagggggacaggcaaggttgtgccctgtataaaggcacctggtcaaaagggcaggggaagtgaaatccagtcatggtgttctggtcaccaagccctggcatgagggtgtatcagcctggaggtaatgtactcttttatgtaattcctcttcccagtagggtgtgtacttttttctatttccaatagtcttaggaagaccctacttcaggatacctagtaaagttgttgcctcctacttacaaccaaagggccttgacattcagacaaaatgtattaacagacagctaaactattcattctaccatataacagatatgctgttcaattccctgatttatttttgcttttttataaaaaaaattgaagtatagtttacatatagcaaaatgtacaaatcttaagggtataactcagtgaattaactgtgcatttcatacatctattaaccagatcaatatacagagcatttccatcaatctagaaggttcctttatcccaatgaatatcattcaccccacacacacacacccaaacccccaaacaggtaggtaaccacttttctgacctctatcaccatactttgattttgaacttcatagagatggaatcatacagcaaatactcttttgtgtctcacctcttttttcattgttcatgacatccagccatgttgctgcatgtatcagtaattggttctctttttattcttaagtaatagtccattgtatgaatataccatcatttatttattcattctgttgacgtatatttaggaagtttccagattttaactcttatggataaagctgctgtacatattcttatacaaatgggcctaggcatttatttcccttggatgttgatgcactgtaatagatatccatattatatatatatccatatatacatacatatacacacacatatatacatgtatgtatatatatgtatgtgtgtacctacatacatatacacacatacatatatatacatacatgtatatatgtgtgtgtatatgtatattatatatatatataacatgcatgtatgtaggtaaattctgtcttgagtcgttccttcacattgtaattgagagaccgtatttttaaagtactgcttcatgaccaattacatatctagtgaacatgttctctttacatattaaacatgaggctactcagtatcatggggaagcctgctttggtttatttaaaaagtggtaaatggtcagtagtattttgtgttacagctaatgaggcaaacttatagtgagggtacctggcattaagcttataattaaaagtctagtctgtgactaggaaaatatccagctatgctacatgaaccacatgagattaagctcagttgcttgttctaaccacctgtgctatttgcaatactaaataatgctggatttgctatgcaaagccctgtaaagcagtgtctgtgtcccagcatcacacgtggagctttttttaaaaaaaatgagtgtctgattcttctctcttacttcccccaaagtcttggtctagattgagatctctgtttgtttgttttgttttgttttgttttgttttaactcaccatgtaattatgtgctatagcagctggccatttctttcatatgtccatccttacaattttggcgattgccttcagttgaattcacattggagactatgaatgagttttatctcctgttaaactttccccaggcaacacgaggtgacggtacacaattcacttaatattgattactttataaacatgccctcattaaaataataacaaattatggacagtggcagaataagacacatttggcgaaataaaacatggagcatgatatgagtttattcagactaccccactagtatgttatattaggctgttttcacactgctataaagaactatttgagactgtgtaatttataaagaaaagagctttaattgactcacagttgcacatggctggggaggcctcaggaaacttagaatcatgttggaaggggaagtaggcacttatttacatggcggcaggagagagagcacaaagagggaagtacctcacttttaaaccatcagatctcctgaaaactgagatctgagaacagcaatggggaagcccgcccccatgattcaatcacctcccacaaggcccttcccccgacatgtgaggattacgatttgagatgagatttgggtgggaacacagagccaaaccgtatcaaatgtaatctccatagtggcagagacttttctctcttttgctcactgatgttctcctagtaagccatagcagggctcaataattatcatagaacaaatctttgtctaagacaaagaccttagttactaacttacaaggttataaatcctgctttgcctactactggttacacatctcagttgctcatctcagccattccagggccagtaggctccccagctgcattcatttgacagtgaccatttgaaacttgtcaaagattaaatctaaggaagagaatttgggtaacttcttacccttaacagagtaagggtgtcaatttaccttctctcctcttcagccatagagccagctccccctgaagtcctctattcctttctccttccactaggcataaaacaaaaattgaatctggccatggtgtcacttttgttcctggtagttaggggatgcagatggtggtggcaactcccttgatcacaccttcatgctctggtcacctcaaatatcctttttagatatgccatttacatagaaaatgattctatctgaattttatattctagctctcctaaagattactggttaaaattattaaaagaagccagaaaaagagaaaccagaaatattttccctttaaaataccagaaaatgtcaacataacaaaactgctgctttggacatgatcacacagaggatggattccctacagtacataaatgaataaggggagaaggatggaaacatatatgtccattttatttcatatatatatatataaaatatatttcccagaaaggacctgggaagttacttcattttgcagatgaatacagtgaagccagagaggttaaatcactgactcagggccatattacgacaaagctagaagttctgaattttccaaccatggttaccagaccccccgacataccccgtagctttaggtttcatgttatacacagaaaaggtaccattcatggcccaaccagcactatatcacactgcttcctctacatccaaggaatacatttattaaaatgtattttaaggtactaaaggaaaaaggaagaaagatctaagcaattttaaagtatctctgccttcccttctgcaattatgaccttcagggcatccatcaatcctacaggcccatgtcaaagaacatgggaaaagatatcttttcagcttgttctgttgaaagcatctaggtgaaagagctattaagccttaaaatgtcacaaattgttcagatattgttcaaccaggaccatttttgtgaatacctctctgagatgatgacaaaataggtagtacataatagagtcacttgagtggagggaactgtggctcctggaaaagaagataattgcttcatagcacttggtgctaaagctcccacaggcctcctctttgtcttcccaaagtgacttttaaggatttgaggatctactgtcatggtgacggattggagggtgtccattgcccctgacctgaagctggataagtggaagaaatagggaggtcacccagggcaatggcagcaaagagtgttttctactctttgtccctgggctctaggatagcacttaacgagaaaaatcaattgcaaccttgtgagtgcagtcagaactggaaactgcatttaaatttgcctactcaggcagtcagccccactttaaagagctttagagttagagatttctgtggcaacagaggtgcacgtgggcaaaaattgctttgcagggtagtgaaggctagcaatgttgttagattggcactttatggctgcccagtttatgtgggcttggctgtaagtaacccaatgaacagtgactttttaaaaagggattagattttctcttataacaagagtttggatataggtggtcctggttgtggtacagatgctcaataatgtccaaaaatcccagaatttttctttctcctccatcattctcagaatgttggcctttcattcatgtgctcatagctgcagaatgcaaattggctgctactacttcaggcctcacatatatattcaaggcagccaaaaaaaaggaaaggaagataacagccatgtatgtccattttatttccatgtattatgaaacaaaaagctttccatgaagctcctgcagattcctccattgatcaagtgaggccacatagccaaccctagctacaaggaatgcagggtacttggcaagggacaatgggatttatatgtttggctaaggctaattactgtcacttagggctagacacaattgccagcctaataaaactgatattcagttagcaagaaataaagagaaaagagatgtcgctaactaatagtgtaagccactatgaattcagaattggcctttcaaaataggaagggcatttactgtatatttgacaataagcaactattcatccctatatttctatactctctagtacattatcatgtaccaaacaggcacttgaacattttgaaccatggtttgagaatactgtaatgacatactcatttaacagtggcttagagaaaggtatgatgtgaaatagtcaacaaagcattcagccttaataatgtcggcattcactttgggtacatcaggagactgacaactgcagataattcaagtaactgatgccaggaagctacaaagtgttctagtcctttaagcttcctattaggaagaaagtacataagaaaatagacatattgataaaataaaatgcctagaataggacaagttgaacctgtgttctagtttcaccacaaaagattttttgccttttctctaagaaattaaactgctgaaacatactatcatgttcacattaaagaattacagcccaaatctatatacagtatatagatttataaatgtcataaagacttgaatcataaaatgctatatgtgtaagacacattaaagaccgcctcagcctgacttcttatttttccagatgaggaactgaggtccagagaagttgcatgatttgtctaaagttatatagttagttcgtatctagaaaccagataaacttgggagacattttgaaagagcaaaggaatgacattttgggaaaagtgggacagagaaggctgcaagtgtggtgatgataaaagtaaatacacagacatgaagggtcatacattgctagtttatgaattaaaagttagaacaatttaggaatgcaggctgacataagctggtccttgggtggaagatgaggtataggaagtaggcaacagcatggttattttatgagaagtatgctgagctcaaacctccaaggcctggagttcagtcactattggacttcagatgtcccttttcactatagcttgcaggcattgtgcatgtgctttatgctaggaaccgtgctaagtatcttatatgaaacccttacagcaacccagtgacatagatcttattatcactactttttacaaatgagaagaatgaggctaagaaagaataagtaactcacaaattcacactactagaaagtggtaaagctaagtttggaactcaggtgtatcttacccccaagtccctgtttatcaccatgctattctcctttttatgttcaaaaaccagattcctccaatgctttggagaaccatagagcttggaacctagaggcaccttagatgtcacctagtacagtgctactcaagaggtgcttttctggccaggagcatcaccatcacccaagatcttgttagaaatgcaagacctcaggccccactccacagctactgagtcagaatctctgagggtgaggcctgggaagctgtgttttagcaggatcactagatggtttttaggaacactaacatttgagaagctgtggccagtgaatagatactagtccagcccctttattttagatgaagaaatggaggtctgatgacttaaccatgggtatggtgccaaaggagcctcaagccctgatctcctgattcctagtccagtgcactgtctgctgtgttctgtggtttcctcattagcttcccacaatgtgcattggtgcctgtgttggaaacactggatggcatttagtagacttctggcctgacccagcatgttcattcatgtgcacatcaggtttctccttccattcctccatgactcagaccaaaggcatttctctatactcgggaggtcttttccatattttccctgtagccctcctcttcttcattatcataatcatagtattattactttgctttttaaaactacttttgcattcattcagtatttcatgtcagcagttctcaaccttgacactctttgtaataacgtggagagcttaaaaaggatactcatccctgggtcccacgcccagagagtctgatgtaatcagtgtcgggtgtggacagggcattgggatttttaaaagctccccaggtgattgcagtatgcagtcaaacgttgggaactgctttttcataagagtctcattattacctgaggagataggtggggcaaacgtaatcctgtttttgtagataaggaagcttgtgctctgagacatttagtgtcttagaagaaagagaataaaatcatctagtgacagttggtgcagactgggttaccagctacttctgataaatctttaaagccagcagtcaggctgtaagaatggggtaaaacctgtttttcttttctggtttctagtgttttctgggtttatgtttcttcacatgagaagggaaaagaaacaactgtgaaatggtacctgggaccaaatgtttataactgaaattccatgctgaatccctttaatgactggaggataatcatcaactagagcaacctgcttcctattcctcatagcccagcataataatgatcagggagcatcaggaaaaccagatggaagggacttgctcattctgcaccagcacacatgccccatttagagaccagttaagaaaataacaaacctggccacactggctaaaagagctcctcagtggagcatgcaaatatggacatgtctgtcttacatgcagaatattggaagagaatttcttatcgttgctgtgtcccttttctgggtaatctaatcatttaaatgataatatgcaacacttttgcttgatgcttcctctcgctgccttgaatgtcgttgggaacttctattgttccttcggtctaacttctcaccttttccaaaagaaatcctctgctgcaaccagcctctctattttcataatcctttgctacttcaagtgtggttgatgaaccagcagtgtcagcctcagcatcactactgttgtaacaaggagcttgttagtaacagaatcctggccccatcctagacctaccgaattagaatctttgttttttatcaagagccccaagtaatgtgtgtgcaccttgaggtttttgaagcattgccccaatacacaggactctccccatcatccaataagttaaaaatgctctcttccccatgctttcatttacccacttcctacttgtccttcaaagctcagctcatattcctcttcctctatgaagccaatatttactccattcacgttactcctttacagtactacttttaggatttaaatgaatgctgaatatttcattatttaaatgttttgcatgtctacttagtctcattattaagattccatgtttctccaacctagcataggctttgcacataatactcatgaattattcagtttgtcaagatcagtttcctacttgaaggtttttcttaagccctattttgtatctttaagcttgctcaacaccttttctgctcatgatgttctctggaggtcactatgcactgtaagagtgctcatgatgttcttcctcaaagaagctcctccaagtttctgtcttctcaataccttaagtaaatctttatctgctacagagatttcctgaaaggcctggctctttcttgtaacctagtggattccaagtgaactacaaccccaaagagatataggaagtaaaaatttaaccacttgtgaatattgactttgtataaacaatttctctaactttttaatttgaaataatttggactgggaattttaaaaaataagtttaattttggagatgagatgttttactactctgttctggtgcccataggaaactcaggatcatcttctgctgtttcatgtgggacaggccacgtggtggtatctcttttgctggtcccagaccctgaagcaagagacacacctctgaggctgccatcttcctgagttccaggcaaaagggaggcacatatcctaacaaactgtagatcctcaaacctgtctggaggcctgttgtaagactcctaaggcttggcatgatgggatggaggtaggaaagcaggaacaccacactcacactgactttcaacttctggtttcttttctatgtcaactcatcccaccttgaacagcttgtatctccatcctgagtttattcggaactatccttcaaatccattgttttatggtatcaattttaagtattaaaaatacccaggaggctgggtgtggtggctcacacctgtaatcccagcactttgggaggccgaggcgggcagatcacgaggtcaggaaatcgagaccatcctggctaagagggtgcaaccccgtctctactaaaaatacaaaaaattagccaggcgtggtggcaggcgcctgtagtcccatctacttgggaggctgaggcaggagaatggcatgaacctgggagacagagcttgcagtgagctgagatcatgccactgcactccagcctgggcgacagggcaagacttcatcaaaaaaacaaaaaaacaaaaaaacaaaacaaaacccaggatctaacaacccaaaaacttttttctttattgttcatgcgtatcaaaagtcatttgtctcattccagtagctctaactttaaaaaaagacatacaaaaaagtcattttgatgtttattgggtagtcagatggcttctttctctaggcagaagcctatcctaccaacaggatgatgaggcaaaggattgggtgaaataaattgctgggtgaaaacattaagttaatatcagattcttactctgttacatatatgtttgctatgatatcagagtgaccctgcattctatgcagatgggcactcagggcattttggactcttgcatgataatgttggtggtgcttgagcaaggcctagggtgggaagtctagcacctccttacagttgtttcagattctgtaaggattgcctgtcaggtcagacttagaactgtacttctgcactaataattcattgtcaccttaagacgcatactccgtatattgtaaaaatgtttccttgggctctacccacttccaaaaacgtgtttggggtggtttacaacaaaaattcacaaatacagtgaaaccattaaccattcaacatggattaaggtttaagaggtaaaatgtttatagcaaaacccctagggtaaaggaagtttctgcactaagcacaggaattaactctgccttttggccctcaagactaagacaaactctcacttcactttgttaggtgggctatgagggtagcttatcacttaggccttcatacagaggcgttagaaaactgtgaacaatatcttcaacagcagttttacaaaacttgtctttttttaaaaaatcaacctttcctttatatagaaaccaaagccacgatagtcatagttagaaaaaataatctgtggaaagccagatttgtatactccagatatacagtgttgtcaggacctaacctaatattgggaaatttaaataatttatagctaatgtatcttaagccagtgcttctcaaactttcatgggcatatgctaccatctggtgatctttttaaaattcagtttcttggctagccatgtgcagaaaacagaaactgtaccccttccttacaccttatacaaaaattaactcaagatggattaaagacttaaatgtaaaacccaaaaccataaaaaccctagaagaaaacctagacaataccattcatgacacaggcatgggcaaagacttcatgacgaaaacgccaaaagcaattgcaacaaaagccaaaattgacaaatgggatctaattaaactaaagagcttctgcacagcaaaagaaactttcatcagagtgaacaggtgacatacggaatgggagaaaatttttgcaatctactcatctgacaaaggtctaatatccagaatttacaaggaacttaaacaaatttacaagaaaaaaacaaccctacaaaaagtgggcaaagatctgaacagacacttctcaaaagaagacatttacatggccaaaaaacatgaaaaaaatttcaacatcactgatcattagagaaatgcaaatcaaaaccacaatgagacaccatctcatgccagtcagaatggcaattattaaaaagtcaagaaacaatagatgctggtgaggctgtggagaaataggaagacttttacactgttggtgggagtgtaaattagttcaaccattgtgtaagatagtatggtgattcctcagggatctagaaccagaaataccatttgacccagtaatcccattactgggtatatacccaaaggaatataaattattctactataaagacacatgcacatgtatgtttattgcagcactatttacaatagcaaagtcatggaaacaacccaaatgcccatcaatgatagactggataaagaaaatgtagcacatatataccacggaatattatgcagccataaaaaggaatgagatcatgtcctttgcagggacatgaatgaagctggaaggcatcatcctcagcaaactaacacaggaacagaaaaccaaacactgcatgttctcactcataagtgggagttgaacaatgagaacacatggacacagggagaggaacaacacacaccaggtcctgttgggggatggggggcatggggagggaacttagaggacaggtcaataggtacagcaaaccaccatgacacacgtatacctatgtaacaaacctgcacattctgcacatgtatcccagaacttaaagtaaaataaaacaataaaaaataaattaaaacaaataaaattcagtttctaattcactgggtctgggctggggcctgggaatttgaatttctatcaggatacctttactgctggtccatggaccacactttgaggagcatatacctcttagagatatcagaggtctcaaatgggcaattgacagaagtttgaggacagataatttaagactggacagataattctgagtcctccatgactcacaccaaaggcatttctttatacctgggagttcttttgctagttttccctttagccctcgtcttcatcattattattatattgtattatattattattactttggttttaagaactatttttgcactcacttagtattttatggcagtagttctcaaccttgaccactctttgtaatccactggggagcttaaaaaagatcccggccaggcgtggtggttcacgcctgtaatcccaccactttgggaggccaaggtgggcagatcgcccgaggtcaggaattcgagaccagcctggccaacatggtgaaaccccgtctctgctaaaaacacaaaaaattagccaggtgtggtggtgggcacctgtaatcccagtgactcaggaggctgaggcagaagaattgctttaatccaggaggtggaggttgcagtgagccaagatcgtgccactgcactccagcctgggtgactgagtgaaactccatctcagggaaaaaaaaaaaaaaaagccccaatgccgggtcccatgcccagaagagtcttagcatgtaccttatcatgcaccatagatgcaggtatctttgttattttgagtgaaaggatctagtatggtaggtaggaaaactgatgtgtttatgtgagggatgaaacgacaaatgaaaggtttggctttatattcatatctattctagttaggctctttttgcaagaaactgagactctcaaatgactaaaaagaaagggcggagtatgggggtgggtattgtatggaaaattggtaggaagccctaaagggagtagccctaaactgttaggaagagggagctataaggacgagctacttttctttaactttctctcttggtatcattgtttcttttagcatatctgctgcagtctcctttcactctcttttttttttctctttttttttattattatactttaagttctagggtacatgtgcacaatgtgcaggttcgttacatatgtatacatgtgccatgttggtgtgctgcacccattaacttgtcatttatatctcctaatgctatccctcctccctccccccaccccacgacaggccccagtgtgtgatgttccccaccttgtgtccaggtgttctcattgttcaatttccacctatgaatgagaacatgtggtgtttggttttctgtccttgagatagtttgctcagaatgatggtttccagcttcatccatggccctacaaaggacaagaactcatccttttttatggctgcatagtattccatggtgtatatatgccacattttcttaatccagtctatcactgatggacatttgggttggttccaagtctttactattgtgaatagtgcagcaagaaacatacatgtgcatgtgtctttacggcagcatgatttataatcctttgggtgtatacccagtaatgggatggctgggtcaaatggtatttctagttctagatctttaaggaatcgccacactgtcttccacaatgaaaaaaaccattatttaaaaaattaattattttatctgtgcggttatgcctttaacttgacatgcagttaaatttgtttcattttatgactttttaaagtctttagagttggcaattttgttattctttatagttaagtttatgttttttaactaattaaaagacttaccaatattagaaaatagaaataatgtgaatatgcacactcacattctttttatttgtgtcctttttcctaatccctctttactgatataataaactttctttttctggtttttgcaagtttttttttttatactttaagttctagggtacatgtgcacaatgtgcaggtttgttacatatgtatacatgcgccatgctggtgtgctgcactcattaactcgtcatttacattaggtatatctcctaatgctatccctcctccctcccccaaccccatgacaggccccagtgtgtgatgttccccttcctgtgtccaggtgttctcattgttcaattcccacctatgagtgagaacatgtggtgtttggtcagtctcctttcactctcactgctggtcagtctcctttcactctcactgctgggtggtttattctgtttttctccatcacagcccctgcttactccctgttgacctcagtttatgcatggacccattcctgacctgtcttcagcagcagctgggattgctgacagcttcattttttttttttttgaacatgcatttcaaattgttgagaggaggaatttgattggcattgtatgccttaggacactggcacacccaagacttagttgctattcgcatattcagtcagtgctgatgggggaggggcaggaggtgtttgatgcctagaaaaagaaatacagctagcaaagactgccacttcctgtaggtaggactcttgccttgggaaggagtcagtggtgaggccagcattctgtggtttggtcctttttattgacttttttttttcaaagaaagtcatctctcctctgcatggaggtagttcagtcatagcatgactttcaggcagggccaagaaatatagtatgagctttattgccctcttgtctcttcatactcaggccaaaccaataggaatatttcacaaggtcagtaaagtgaatcagttaaactaaacaaaacggtttaaaccaaaccacctcagatttgctttgtatttttgaaatatcttaatttattttaattcaatgtaaaaagaaaagaatctattccatccaaaatatcaacaaatgcattgatcttaggggctacaactacaggagagggaataatttgggtttgtttggtgaaggcctgatggccagggagccccgctctgccattcctagtcatttttgttcccccaccggaaatgctgctccctcattcccaggatctcagagtgtctcaaaagcacagaggccatctttggaggcagtgggtgtgctcatgcttgtgctcctgtgtactaggggcagagagtggagggatatttgagaaagcagacacaggagaacaagctcaagcccttaccccagaatctcaactcccttcttctttctgtactgtttgttcgggggcgaaaaatactcttcctcagtgttccccacacacaggcttttaatgaactctgtttttagtttttatttgctgatcagtaaactgagggtaggtcttgtctgttcccagagataaagaactgcatgcataactggtctctatccagccgaacaagcgccggtttctctttgtttttcacagtgtttctgagagataagaggaaaccacccagacatgatacatgaccatgggaggttttgaaataatattttataaactcattccctattctaagctgtggattcgggatagaaagaaagggggagggcaccacatatagtgtaagttgatttttttctgggttaaaaataagcaggcaaacacacacgtacacagacatgcacacacacacacacacaacatatgaataaatgttcagctggggaaataagccaattttcagttataggcatgaaagtcaaataggaaaaattttagtagtgcaaatgaatacatccctgaaaattcagtgactgtttcctaccacaaaaacttcctctgtcatatggattcaaaatcaatattgagcagagccagatatattcccagaagactatgggattcaatcaggatagagtccaattaagtgcatgcccttcagggcttttagcaggtttctgagaaagaggggttgatttgagacaaatgatgatgcaagattttaagtagtgtaagactaaacttaagatcagttggcactgataaagacacaaagagtaaatgttttcaataccaaatgaaaattatggtagcaatttgaatggttgtatttaatcatttaggagaaatttgctattaagctaaggaaagaagacttggggctgatatgataggacagtggggatgcagcataggaagatagggtcttcaggaatgttaggaggagtacacttaagagacagagagagtggttaataaaagggaaatttaagttgaaagccatgacatcattatttcagcaaatagaaaaaaaaaaaagagaatgtagtcttactgaagccgagtccatcttacctactctgcattactgtttctttctatctctaggctcatgagctttagttgctctattgtagactcttgtctatatctcatctccagtgctggatggtaacttgcctgtagggaaaaaatatgtctcatggtttctcaaatttctccacaacacctagtgtgggaccttactggaatagtagctcaataaatgttaattggcagaattaattaatgaatggtatcctcatgaagtaattatttttccaaattaaatgctagattttgggaaaccaaagctggattatattttttccttctaataccaggtaaatcagaggagcaatttatgaataaatcattagaaacttatttcaaaaggaattggctggtctaatgctggatattgggtaggaaaattaaatgtgtcagttttaggagagaggccaaaatccaacggactttttattgatcccagattcattcaatcagactaaacttagatgttttttagttttggttaatctgaccagtacgtttcctgtgcaggtctaccttttgggaagattggcttcatgagagcacaggttctgtctatcttgctcactgtcatatctccagcatccagaacagtcttgcctggaatgtagtagaggcttaagaaacaatcgtggagcggagggaaagagagggacggaggaagcgaataaagaatgaagggagggagggctctgaatttcataccagttaaactgtcacttatttactcactcatcggttgtgaaggacccccctcagactctgtgttaggcaccaaggataccaaaattatgaggtgccacagtgtttgctctcaaagaactgatagtctagtgagagagaaagagagagctctaacacaacagagagagatctaacacaacagtgctgtgcagcagagcaaatgtcactgtcataaagggagtgtgccaaagggaacatctaatttgtcccaggaagggcaggatgcaaaacatatggctaacctgagcagaatcttaataaatgcaatgatgctttgaaggcttgagaaccgtttaatctctatagtcctaaaaccgactgtggacagattgaataaaacatggaagactgcaagtcattacattttagccattctctattcagagtcattttgatattagaagttattttgtgttgacactattggactttggtttcattcaggtagtacaaatgcctacagtgagtccgtcatactgcagcttatcacagaatcatggctttataagtacagtctttataagcacagtctaaataacacaaattgaaggtctgatgtttgggccagacctacactgtacaccaggagtaacagctttgttaagcataatcagttaggaccactatttgttcttttctgagcaaatccttgttcctgtgacaaggattaatgatatgacagccataaggtagtctttgtattttatagcaacctatagctgtaaaggtgtgtgttttccaccgaaatggcaagttttctaaagagggtaggtttgacaacttgacaacaaaggaagaatcagtggtaaaaaaagaataaattttcgttgactaagtttatttacatatagtacaggattctgtggatatgatgctagacttcttaagcaagaaaattcagtgtctaaggaaaaaggagatcctgctttgacttctacttctggatttccttattcaggtgctgactccagcacagatcaagtcaatttgtcaggcaattctggactctgggaagcagtatgccataaagaagaggaaaccattccccctgatgtattcttactatggaaccgaatacttgggtaagtgaaggtgtttgcatgggcctgtaggaaggagaaagtctctaagatactaccaaataaaggctggaagattttgtttttgccataggtcattactagtcatttaataagaaatactttaaaattttctttaaaaacctatactgatacataacacaaatcacaagttaatatttgttttcgtagtctacctgacagaaatgtagctattttaacaattactttcactaaagactaatatctttattctagattgtaagctcattggcctgattttgctgaaacattgtgaaaacttttcacacacgattgaaaatagtgcctctgcatagggaagtaggattcagccactaacgttttgaagtttttaatagtagtgtgtttataacagactattgaattgtaatggctaatggtgagctctgggccatgcaaaaaaaaaaaaagggaaattagttactcttcttttgagtccttcaatggcttaccattactactgagcaagatttgcaaggccctttatggaccacctgcctctttctctagactcaaactttatctttaccctccaggttctgtccagcatagtctcccacatgcggtgttctctttccacctttgtccatgttccttttgcctagaatgccctacttcccccaacccctttatctatctgtaataattatacccagatttcaagactctgctcaaacatcattaatctgctgaaaaatgttccgtgcttttggaaaaagggttgttgaatcctctctggagaaagattcacaagtttcaggttttctcccaaagcaaaactgggtaacatgctgtcatcctgcgtatacttctattggagcccttattacactgtaattagtggcttacctgcctaactgcctgagcaggctttgtacaccttcaggatgggaactttctctcatttatcttcatgattcttagaccttcaccacagagcttgcaaataattagggaacccaaatgaatgaatgaatagctaataaacaacttcaatgagttttctcaaagaaattttatgtctgtttaagtttccccaaaatcaaacgctgagacaaggatttgggtgtaaaaggtttatttgaaaggtaatttcagaaagtgttgatagagatgtggagaaatgagacaagaaagagaaagaagctaattgagtgtgtaataatgagcaactgtggacaactgaggctcagttcccctagggaatcttagagactttatagaacacatctcagaatcgtttcacccaaggggtgaggaagctggggtattcatccaccaactctctgctttattgattggctgctcctagaggtattaattccctagcaattctgtcctgcccctttgggcagggcatactcctgtggccagagaaagcctcaggcaaaatgatagatgcttgagatatgaagcgggagcaaagatgcatctgaatgttgagtgtagatgaggtgatgagccagggcactgacagtgtctgctatagtcccctaatctattccattcatttttctggttttattttttgagacaaggtcttgctctgtcacccaggctggagtgcaatggtgtgatcatagctcacgcaacctcgacctcctgagctcagttgatcctcctgcctcagccttccaagtagctaggactacaggtatgcttcagtatgcctggtcaaatttttatctttaattttttttttttttttttatagagacagggtcttgttatgttgctcaggctggccttgaattcctggctcaagtgatcctaccaccttagcctcccagtatttttcaggttttcgttacagaaattaacattctggctttttacatatatatagcttaaactatatttctatctagtgcataaatattttcctgaaaagcaagctttttttcccaacaatttcgaatccagcaaaataaagatattttcacatttcatgatcagattttaagagcaatagaaattttgactgaatacaaactgtaaagctgtttccagggagtcaagagttctgagtatggcaaagtaaaagatccctgaatgcaaaaagaaagctttaaagttatagagttgagtttaaagagcaagccatcagaatacattgaccctagtactgcccactaatcgggattctactaactgggaatgagtgaaaactcctagagggactggactttgacctttgttaagctaacttcttttccaaaggcaggttcaggcctttgctagttcaatacccattgctagttcagaattctctgaggaattctcaagactttgctcagatgacactgtctgtatggaaccttcagcatcccctccacctctgaggccaagttaagctctcctccattccttctattagtccttgtagtagtcatggttctctagacaaacagaatatgatttcttatataactaaatgatttattgtaaggaattggctcacatgattatggaggctgagaaagccagatccaggaaagccaataatgtaagttccagtttgaatccaaatctgaaggcaggagaaggccaatgtcccagttcaaagacagtcaggcaggacaaactaattatttcttactcagactctttattctattcaggccttcagtgaattggatgaggtccacccacattggagagagcaatgtgcttagctcagtgaacaggttcaaatgttatttttatccagaaacaccctcacagacacacccagaagtgacgtttaaccaaatatctggacactccatggccaagtcaagttgacacacacaattaaccatcatactcctggtacacattgctcatagaacacttatcatgtcatgttctaattatttctttacaaatctggccgtttcattggactggatggagaggtcttcaaatgtatcgaccaaatcatgtttatctgtataaccagggttagacagtgcctaatatgcaagtgttaaatgtaaaggattaagtaaatgaatatcaataactagtgttaacattacaaaagagggatttagtctgttttgtgcagtgatctatcctctgtacctagaacagtatcttgtacagagtagatgcttaatacttgtgtgtcgaatgaataaaaaaataaatgtttaggatacctagaccaaattattttcaagcattttaggagcattttcatgaaagctactgatatttcaattacaaagttttaaaagatctcttctctaaaacagagtttggtcagcaaattttttctgtaaagggctagagacagtaaatattttcagctttctgggccgtatggcctctgtcacaaatacaacactgctgttgtagccagaaagcagcaatagaaaatatgcaaatgaatgagcatggctattctttaataaaactttatttagaaaaactggcagtgagccatatttggcctgcaggctatagtttgctagaagcctagttcttaggcaacttagttatcacattgctatatgagctttcaagtaatattggctttattgttttatatcctgttgatcttttcactaaatcaaactagctgtcctcccaattgtgtgaattttatgccttgtttgttaatacaggggcagctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggtctcacacactctgttacctaaaaatattgcctttcatctaggttagccacagggtggttccttttctgagaagtgaggatagctaatcttatgtcattactatgtgagataaaagggtcaagatgagatttttcaaagccaaatgtcctgatcagtaaacaacttctgaaaatggtcctctacattttaaaatatatgatctatatctatttgtttataaagttaaactaacattgtccaatagaagtataatatgagccacatatgtaattttcatttttagtaacctcattaaaaaagtaaaatcaggcaaattaattttaataatatatattatagttcccagtgtacccccaatattaccatctccatgtatatctgatttgaaaattgagatatttcacattttaaaaagtattcagtccttgaaatccagcatatactttatacttatgtcaaatgtcaatttagactagccacatttcaagtgctcagtatctacattggatagtgcagatctggagcctggcaattcaaaatgtggcccctggaaccagtagcatgagcaactgagagcttgataaaaatccagaatctcaggccccaccctagacccactgaatcaaaatctacattttaacagtatccttagacaaatcgtatgcactttaaaggttgggatgcactgttctacaacttcttcaaatgagaatttccatcagtaccaaacaaaatgtctagaaacatgaatagtcatccccagtaaactctgtggaattgaggctagaaatttagcaaaccctatctttttcccacttttaaaaaattccatcacactgctattaagccttcacagaaggggtaatttgaaaaaaagttaaattcaaataaataaattaatattggttagatggccaggggagagatttaaaataccaaaataatacaaaattcttagattctgagtcgatttaattttcaaggccatgcttcaatcccacaagcacagttttaaaatatatttgatttctctgtagtttttttacctgagtttcattaccttttcctcccattaattaatggtctttaatccaactataatttcattttggggggtacagtttgagttgatgaataataatccttgaaagtatagtcttgagttgatgaataatgtaagtcgcagtgtattggtcatattttttctgcctgctacatttacctatggaaggaagttcaaaatgtgtgcttgtaccagtatccatgcattgtgtgttatgtccaggctaacttctgccaattatgatttgagcccatttctttttaatttgaccttttttgtgggcggggggggaacaagttatttaccatgctggaaatgatatttcttcttgttagcctcaatccttccatttctcatttattttaattattctcagtgatggtctctggatatcctccaagcataccagcaaggatccttgaattttggagacataccaatttaaacacagaatatcttaaaaggattcaatgtgctagtaatagtcctgaaaaaagtgggaagataatctactaaaatgaatgactgggtcagttaattgatgtgggtgtcttgcagggcaattattccatcctttctgtatactaaataccatctgtctttgtaaatcatttaccgtaacagtgcagcataggattcatcactttggagactatatcctcctttatcattcatgttcagtatctagagaagattaaacataagttttaaagaaaaatctttcagtccatgtattcactggactaccaaaaataaaccaattcaaaaatgaataaaaaactaagtggggcccattattttaccaacccctatccccacctcaagggtattggtctttctttgaagagatgctctaaaaacagcatcaagattgattataagtctaatcagtgcagtccaaagaccaccaagattttgcagaggttggcaacatctccaaaaattctatgcaggaaacgaactataaaataattttcatttatttaaggaaaacatttttgagagtagatttatgaacagtgcagatggtttgaggcagcagactaattctgtgattaaaaacctgccagaaataattcacaacgtggagcttcattaatgataccttatctgttcctataattgtttcctactggtgctccttcaacccacctccacaggtgacaagcctagttatcatttatgcagtgtagaaatagttctttgagttaataactccagcttctaatttcagctccaacactaaccagtttactgaccttaagaaagggtgactttgtttctttagtgcctttgtctctttatctgtgaaatgagcactttgagactgagtagtggaactcaatctttttatcaccacagacccccttttatactttggtcctttgccattcctgagggctgttcctcaagagctttgtgaacaagacatttttaaataccttgtgtggcatatagcttttttctcaataagtgcagtaaagtattacaggaagattaatgtgaccccttcataaccttgacaattctgaaatacaggaccaaagtcatttacaaaatcattaaaacaaatgctgtggctaaaagaaactctcaaccgcattaggttacatcattgctgtggtaacactgacaatgcatttccttgactctgcatgaagtacaggagtgggtatttttttaaaaaaactcatttcataaaagctcttgggtaggtgactttgaataaagaacaacaaggcttttgcagtgcagatatcgttggtcattaagctctgtagtgcgcactgtacaatgcatgcctcagcggaattacacaacccagaatggacctcagtggtgattctccagtgtgttgaagctatacgtgccaagtgtggctgtcacaaggtcctattagatcccatattttcaaaagtttagtctctcaaaacatatttattaagtaataattctttttcccagttgcatttggcaaagtcatacatcattactgactcaggcttcttatcaatgcacaataattagtgttcctatgatgaaatgatgtggctcctggttcctatcaaaagcaaagaaacccaccattcctttttttttttttttaattaagcagccttattgtggcttccattatgctgggttaggagccaacaggtttactaaattttggtttagaagttttgcgaggtcacttccatgtaacattctgtgatccaggatgcaggaagaggctctttcaccctggccagaaccacaggatcaataccttttaagcgttctggggctcatggcctggtacagcaattagaccatctcacccttcttccttctacatctctcatctataccccagtatcagcctgtgctgggttgagaaatggggcactttatggtcaacagacatgtatgaggttcttggcatttgccagacaccatgccacacactagtggaacaaaagtgaacaacatacagtttctgctcttgagtagtttgcactgtattaggggaggcagccatggaaataggtaattttaactgggttctgtgtaagtgctaaagtttgtataggatcaatgaaatctcagaggggttcctcatgctgccttcaggtccagggaaggcttcctggaggttgtgatgcctaaggtaagttagccagatcaagaaaggtacaaagcttgttccaagcaaagtgaaccacattggtagtaagaagcatggaagcactgtaggtggtttggttctactgaagtgaaaagtttcaagaagggaatggaggaaaagaggtgggaaaatagaaaaggagctcagtcacaaggggctttctgtgtcatgctaaggcatctgggtaatagggagtcatttagtagtttaagcaggggaatgtcatggtcagattacggtcctagaaaggtcattcactctgccacagaatgaatttaaggcatggcagacctggggacaggaggctaaagcaatcatctaagaaggacacctagagcctgagagaggccagcaagagcagggtcttcccacccaccttcctttgattggctgtaataccctccttcttcaccaagctctttcctcaggttctagaattagagcttggtatcaagaggaacctgtaagggagcagggaagcagaacaggccaaagaggagcatgtcttacctggagactagcttcaccctgagtctgaggagaagctaagaaacacagtttacatcaagaagctgggtctctcttgaggcaaggaagtcaatattttgtatccctgtgtcatccctgtgaggggtggctgcatagcatagcctctcatttgtctgagggcaaatctctcaagaagatgcagcagtgagctttgttagttgccaactttcacaggaactgggaaatgaggcacttgctggcaaggtaaagctgatccatgcaggtcatcaacagcatccagtacaccttgctaattccttatcaacccccaataatcaggttagatggtgtcacccctctagtagtcatctccttctaccaagtgtgtgctaggggccctcctgtgtgcttccatgagacttctatttcccctcacatagtctaattaatacttccagttaagctgaaaaacaccatgaagatagatgctttttaaaagcttaacacctgctactgtgcctggcatatagcagatgcccaattaatatagaaacacttaccaagttctgtgaaatgtctctttcattgactttctatttttttagagaagctttttttgtttcttttttttattgaggtgaaatttacataatatacaattaaccactttattattttttattttctccacttttactttgattcagagggtacatgtgctggtttgttacatgggtaaattgcatgtcactggggtttggcgtacaaaggattttgtcatgcaggtagtgagcatagtaccgaataggtagtttttcaacccttaccctcttcctaccctccctcctcaagtaggccctggtgtctattgttcctatctttgtgtccatgtgttctcatcatttagctcccacttataagtgagaacatgtggtgcttggttttctgttcctgcattcatttcctaaggataatggcctccagcaccatccatgttcctggacataatctctttttttatggctgcatagtattccatggtgtgtatgtaccacattttatttatccattccaccactgatgggcatctaggttgactccatgtgtttgctactgtgaatagtgctgtgatgaacatacacgtcattggcttcatttttgtctttctgctaacataaccagctcacagctaccctgttacccttctttaggtctctcctgataccactaaaattgggacattttgtccataataatcacattgtcatataaaaaataaaagccaaccaatccaaagcaaaaacacttccattgattccctgatgaccacagagtacagtccaagctatctaattagatttgtaaaaccatccataatcagaacccagtctagccttcttccccactggtctgttggttagaacattgccccactagccttcatgtggcttcttcctgcctccatgtctttgcccttgctaatcttagtgctagatagaatgccctccctgcttcatcttgggcctggaattctctatgtatccttcaaagttctgaaaaagtgctccttccatttaaggcctcatctaactatctccgtagggaacttccacctttctgattctgctagtattattgagagaaccatttattttatgttccagcagcatcatgaaatatatatcctattatgtatcagtcatatgcatatatttttatctccctttttagagagtgccttcctgaagggtaggagtcatgtttagcatttattcaatatcacccagggctggaactgactatataatttgggaggcccatagcaaaatgaaaatgcaagttatttttagaaaaattattaagaatttcaaggtggtaatagcagagcattaaactcaacatggaacccttttaaggagtatgggctgtaggcctgcacaggtggcatgcccatgattccagccttgtctagggctgtgcgtacagtacataatcaatgactactctcaaatgaatggatgcaatgaatgaatgaatgtatgaataaataagttcagttcttttaatatcatcatttagtttgtgcaaggtactttgttcctaaaactgaggtaggagaatgctgtaggtaaacattgtcagtagttgactggaaagcattgactgaacaaagagcttgttgctttgtaagtattaaccacaggctatattaaaggatacacttaaaaagggtatgaaatcatgactctcatacaaatataaaaagaatatgtatgaaccattttactgagctcattatttaatgagggaaccagaaagatgttacaactgtttcaaagggaaatccaaagagtagacatatttatataggccattaggaatgctgaaataaatttgcttaatagatgcaaaactggcttcttccacagaggcagagggaagtcaacctctaccagacagagtgtgagtttctagggacagaaaatatttacattactatcagttttctacaagacaatttctatctctacagagttgtaaaatagcctagtcaaagcaatgaaaggcaatgataaccctgattgatgaggtagtcaagataccagctatatttcagtctttcacactttttatataggagaaaggtaggctatgcaggagagaatgtgatcttgtgataccaacctcctcactgaatatgaacacccagaacttggggaaaatcatttctattaatagctgttgcttctcttgtttctcttgtaactgatactacttttgttgaagagctttgaaggaacagttctttccttggaacaatcagggtgggaaggactcacttcacagctaaagtagaagtcttggcaagatccttctggagcattgtttttcttggaaaaactcccagttttgcttttaagaaaatgtgtatagttataagtacttaaacattacaaattttaaactacaaattcattacaatacaaatatttagccatttcaaataaccaaatatacataatgcttactagagtatgcgtcattaaatattaacccatttgtaaattaaattttagattttatcaatctatgtacgtcaataaaaatgttgctctttctcccggggccaaccccacaatacaattaaaacaaattaaaatctcactgggaaaataagattctcttatagaacattctagcaccttcctactcaaagtgtggtctttagaaggatgcttgttagaaatgcagtatctcagggcccacatcagaactacaatattagaatctgtgttttaccagtactcaggtgattcatgagctttttattgttctggaagttctgctccaaagtattaagtcctgaaagtcacctctaatatctttgatgttttcacaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaaggtcagctgttctttatgggtctttttttttttcaaaattttaatctaattatttttctgaattactaatatagtcacatggtttgaaaagcataaaaataaatacatcaactgtgccttgtagccatgcagttgacttccctagagacagtttcttggttatcttcccaaagatattctatatacatagtgtataagtaaatgtcttaatccatttgagttgctataaaggaatacttgagggtgggtaatttatcaagaaaaagtttcctctggctcatgattctgcaggctctacaagaagcatcactagcatctgcttttggtgaaagcttcaggaagcttctactcatggcagaaggggaaggaaaacagacatcacatggggagagaagaagggagagaggaggaaagtgccaggctctttttaacagtcatctcttgggagcaaatagagtgagagctcactaattaccagaggatggcatcaatctgttcatgagcaatctgcctctatgatccaaccatctcccactaggtcccacctccaatactggggatcaaatttcaacatgagatttgaagggtcaaatttctaaactataatacatatatatgtgtgtgtgtgtgtgtcttagggggatatttaggttatttctaatattgtgtactacaaataatgctatgatgactaatcttgtgcatatataattttgcacatgtataggtatatctgaaagataaatttctagaaatgaaattgctggactatatatatatatatatatcctagttatatatataaatatatatatcctagttatatacataaatatatatatatttataattttgacaatataaaattttcctttatagttcattccctgtaaacttgataaagatggaacatctgctgtataccagacaacattgcttttaatagatattacctctgactggtaagctgggtaaactgggccaggaggaccataaatgaactctaaataatctgatagaaagcacaagtaggggcttccctgaatgcagagtggcatgaaagtggcattcattttgaagggacttagaagctgtccataaccatgaatggttacaaaagatattgttttcctttgtggcacttaggtcttctaagccagagtgttctctcatacccacccatgtagtctggttcccatgaatctgagctgtcacttggcagaggtgggagggggtcctagagtagcccctgtactgttgtgaagattcccactgaaagtgtacagctgataattatcaaattgattgtgtgacatttaacaaatcacttattaaaatgagctaagtgactgttaagtgatctttaacaaggtcacacaacctttaacaagtcacttagctcattttaacaagtgattctccatttcttcattcataaaatatggaaaatagtgcctacctcatagggatgtttggtagtttaaacaagttaatgtatgaaaaatcatttagaaataatgcttggcatatagtaactgcaatgtaaatgttcattgttattagtataaatttgagttttataattccagacttttctttatgtgtaaatgtatgttcacataaatgtatatgtgtacatgtatattttaatgagctcctactactatatatgtataatagttctatacatactgtttgtagcttataattttatttatttatttatttatttgagacagggtctcactcaggctggagtgcagtggtgtgatttatggctcactgtagcctgcaactcgtgggcacagctcagcctcctgagtagctagggctacaggttcatgccaccatatgtggctgatatggtttggatctgtgtccctaccaaatctcatgtcgaattgtaatccccagtgttggaggtggggccaagtaggaggtgattggatcctggggacagagttctcatgaatggtttggcaccatcccctcttggtactgtatagtgatagagttctcaagagatcttgttgtttaaaagtgcatagcacttccccctcccctcttgctcctgctctggccatgtaagatgtgtctgcttctccttcacttcctaccatgattggaagcttcctgaggcctccccagaagcagaagctgctatgattcctgtacagcctgcagaactatgagccaattaaacctcttttctttgtgaattacccagtctcaggtatttctttatagcagtgcaagaatggactaaaacaacaactattaattttttgtatgcagaaacaggatcttgctatgttgcccaggctggcattgaacacctggcctgaagctatcctcctgccttggccttccaaagtgctgggattacaggtgtgagcccaccacctccccgctatgtttgcagcttataattttaaatgaacaatttttaagggacattctttatttcattttgtatgaatctatctcattttttaaaatggctatatagttattcactatgcatgtatgataattaaccaatccttaaataatggacacttgacatttgtgtaatctttaataacacaaaatttccccaaatatccaatacatacatttctgtgcacttgtgaaagcacttgtcagaaattttagaattgaagtcattagatccataggtatttcttggtctataaatagcctgtctttatcctttgcccatttttttcctgttgtgatgcttctattcagaattgtaactctttgtcaatgtatgctgtaaataccttcctgctttgccatttctcttttaattttgtttgtagcctttgtcataccaaagttttaagtatttttcttgtcaaagttttcaatcttttctttaaaatttctagattttctgttatgcttaaaaagacccttcccacttcaggattagaaaactattaatttacatgggcttgtaataattttatgattttaacattaaaatttttgattctgctagaaattactttttaaatggtctcagataggtatttatttttgtttattaaaaaaaattctaatagcatctgttgaccagttacccccatgatttgaaattccatttttttataaactgaatttatataaatatatgagttccatattttccccatattccacctatcattctcttatttattcttttaattgtattttagagtcaatttgtcatatttttaaaaaagctcacagaaatttgattggaatttcattgaatttacagtttgcttaatgagaatcagcatctttagaatattgaatttttccatccagaaacatggtatacctttccatttatttaagtttaaacaaatgtcattggtaaagttttgatcttatgaagaagatcttgtatgttttttgttaattttattcctgggtattttatgtttctaggtttattgtgagtggactcttttccttcattatattttcatatcatttattactggtatttatggaagcttttaaaacacacatcactgaagtttatcaattctaatatgtaatttttcatataaatatagattgtatcttataagtatttttcttttcataaacatcataataatatagctgccttaatgaactccattactgtttctattagttttttattgattctattgggttttctaaatagatacacacatatctgcaaataactatgattctgttacttcctttctcatgtgcatggtattttttttccactacatggttcttctctataacaatgcaaccctataacaatgttcaataataagagggatagtaaacacccttgcttttatgctgattttactaggaatgctcctatgttttaccgtggtcttttatattcacttcttataatgtttatcattataaacattagattataagtgttagattataacacttctctgttcagtgtaatccaacggcttcccatatgattcagagtaaaagccagtctttcctacgaatgaaaggtcctacatgatctagcctcccattacctctctaatctcattccctactcttcttcctcctggttctgtctaccactgtggcttccttgtaattccattaggatgccaggtacactccacctcaagaccttggaagttttggttccctccacctgtaatgctcactttctacgtatatctcctagctcccccatttcagtcagactttcactcaaaagtcattttctcagaaaggccctcccaagtcaacttatctaatatttaatgtttagaaaacataaattattttttgtgatatttacatgaatgcactgaagggcaaatactaacttatgtaagtctttgatttgaagctctgttgtttaggaaatctgttaatataattgattcatggtttcttaatctctttaggtggaagccagacctgttgtttcccaaatatagaaaaagaaagtaattttggatatcatctaggctagtgggatttcacctttgggctaaatttcatcagaaatgaatgaaattcatttattccctataaagcgtattaaaagggatcagaacaacccctctattttcttttttgtaatttttaatattttaattttttaaaatttgtgtaaatgtatgggattcaagtttaattttgttatttggatagattacatagtggtgaattcagggctttagggtatccatcactcaatgaactttgtacccattaagtattttctggcaggccagtcctagcttacagagtcttggttataagatttagggtccaggtctctttagacaacttacatttctcactaacaggtagaagactggaaatgtggaggtaatatctgagtattgtttgggcattgtgtgaacaaaagttctctgaaacggaatgtgtaggaaagacactattccagtgaacagtttgcaaacagaggatacacggcctgcggtgtaaaatgaagcagcctttcagcgctgggttttatagcaaagttgcctgcccagggtcaggtctttttatgcaaatgaaggattgaatctcagttccgattggtcagtgcagctgagccctgattggccatggcaggtgactctgattgtttggcttaggtgtgatctgattagttactttccaagctcaaaaccagaagtctttgtcacctgtttcttccaaatggcgggtggagggctggcatatcttggcactcacaacgggaactggtttggagaaaggtcctgtgatgcttttacaacgtctttctcagaacacagagtacatgatcactccctcacccagccatagctgcctggttctgttttaacttggagcacctcagtttgccatggggagcccattttgtctgttggctaggggcatactttaacaattgcatgttaaaaaatatgtacctccctaaaatgaatattacttggttgtcacctattattttttaacatacagttggattttatggctgcataaaaatatttgacaacttcttaattttcttttatgtttattcaatcactcgggttttctacctcttctttttggtagtgcacatatttctataagaccatctagttcttatgaattttcaaatatttgacatagagttctaatcatatagttccataatatttttaatttcctatatctgtggctatgtgccctttgtgatttctaatgcttttccttcctggtgagctgcaccagtgttttttctgtcttgttaatcctttgaaggaactggctcctggttttgcttattaattttttttgtttttctcttttgttttccacttttacttccttttattttgttatgttctagagtttatacatgctgaattagaaagcattccatcattttattaataataatggtaactcacagatctatgaattttcttctgcattcagttttggtcataatcaatgggttttgatatgaaatgttttcatattttattgtgtcttctattctttttagtcctgtaattagcatgctgacttctattttgactgagaacgttttagaaaaaaaaatttgtttaattttgcaccactggatagatttttgaaacatttttcacaaataataacacaaaatacaggtcagaatacaatgaaactgctaccctcagacattgctggtactattttaagttgctatgtatcatttagaaattattttgaaaagcatagaaaaatatttagcatatttttaagtgaaaaaaatacaggataccaaatcatatatactttaataacatgtaataatgcaacaaataaatgagtgcatgggggaaaggtcagaagaagagctagcaacattgtgggtttcttttatactatgattttacaaatcatctttttgttttataaatcttcttttattatatgtttatgtaaaaagtaatattttctatttattgaatgcttgctatattctcagaacctgatatataataccctttatctttacatataacactatccagttctgcaacttcaccattttaaagtcaaattgagaaatttgccaaaggtcatacaacatgaaattatggaatctgtgtatctcacttccaaagcccttgctctttctactataccaggggttcttaatctaggatttgtgagtttgcttgacaaagagattgtgtctcaaacttaaatgtaacatttccttcttttctgaatgtaggtagtaagtcacagaagtattagtagctgtgactttgcaaacaatagaattcatagatattctcatgtcatattactcttgttgcagatattgtaaaatcttaattttacaatatgcagaaatgctagcagttactaaatccactattgtaccttggaatttaatgtgttagcaaataatacatatgttattatatcacaaatttggctttaaaatttttgttgtgttttaatataattattttcctttggaatcctgtgtggcttattttatacacttgaaaactttttttctgaggagcccaactgaagctatatcatgatgctggctatattattacaaatttagaagtaactcttacgatgcattaatagtctactgtttaaaattttaaattccattttaaaattgtttcatattcaggaaaacagttatagaaaaattgtaacaaatataattacaatctgttttctgctaatttattttaagttgccgtatgtaattctaagagccctaaaaaaatcaaataaataattaccctttgtaagaccccctatgtagtagcagtaacctaaatttatgacagtatcagcgcttgggccttaccaagctgtgaactccagcctctgaattggtgattatttgtgttcttgatgggaatgagtagagcaagtcagtaaaaaaagatgatgtaggtaatggcactttggaagctgtaaactactgtaaaaatgttacttgttaaaaataatctgaataatatttgtggcaaatatgggtaaaagaaaaaaggtctttcatagggaatttagaggcctgtgatttaatttaaggcgaatgtctcaaaaataatctgtcttgtagctgcgtttgctatatgatgttatcattgtgaaaggttgctgccttttcctattcatcttattcccttgtttgctcacagcacagattgtataaaatcttgcccatttatttttacagtctctgctttttgtcatatataaacaaaaacccagcttagaggtaatgtctgcagaaacacagcatatttacttttttaaaggaacagtcacgtatcactttgcttcttttcaagataaataaaagtagagcaatttgtctgtctttttttactttaattactggatgacagaaagaatgagatccttgaaaattccaaactgctttgctttgcaaactctaagaatagttggatttgcttgccagcataatttgttgtgaaacatacacagttatataatggatcttcttctttaacagagaaaatgtgtttcttaaaatacttaattatataattctggaaagaaaattatgctaaaactttaatagaagaggaagaagcaacccaaggtccataatatggaaacactcatgttaaactgttcatattttcttcttctcttaggtttgctcaattcttatttaccgaggaattcaaggccggttctcgggtccttgaaagtatatacagcttgtatgaaggcttctctgggacagtgtgctttctgattgacctgctgcagcccaatcaggctgaattcccactcttcagcgtctttgtttagaaggctctatcttccactgtggccctgcagagatcccctgagccaagccgaggcagtttccacataagccacattcaatggtatcgcaaccatgagccttaacattgccatcagaaggaaggaatcaggcaggtgaaggcaacatgatgccagatttgagaaaggatctgcaaaataaagataccacaattcatcttaaaactgcagagatttaatgtgtcagggaatagatgtgaaacaagggatcataggaaaaggggaaagagaaatgatctgtttttcagttatgacatagaaaaccaaactgcaagtgtagactatgacaaaaaatacactaatacctttgcaatctgaatgagaatttgaccatttgtgtgtgccctctacccttaaattcagaaataaagacaataaaaaattaaaataattgcccagctgaaaactgctatgaggaatggattgtcaggttgctgaagtataaaaataaactcttggttgtcctgtgcttatacttattgaaatttatggtttttactgagcaaagatatttgcatatgaatctctatttttttcattaccctgggcaatttaaagaaatcatatcatagcgtagttcagatactaaaatttgaagtttccttaggccctagaacatctcttttcctggttccttttttttcctcaaagctcaattagaatagcaaaatttataagctagtaaacttatactatagcaagtgttgctgtaaagtgtttttctccataggaagtgtgaactgtgtattgtctattgttagtaattttaaaaatgcctttatgtacataatcttgatggagctattagctgaactataaaatatgctcttggtaaatatcactaatttcaaagatcaggggaaccactacaaagacgtgtcatttctgcctttgtttgggacaggcagacaggctgaggaagtcaccagtgattgtggaaataattttgctccattttatactattaaatgaagagatgagtgaattctgtggttggttaccttaccttccaagatacagggtccactagaaattggctgtaatactcattgagccaagttgtcatatcaaattcaaccctgctgtaaacacatagaagttgtgaaactgcttcaagtaaatagtggtttgcagaacactgtaggagcatctgtcacttcattatgcagagcataagttgatccttttcctagaattttgtcagtggcaattgcatatatcagattgagtaggaaattgtgtactgtataagacttatttaaatagtcattaaatatttggatatattatgtgtgtgtgtgtgtgtgtgtgtgtgtgtatggtgtgtattccatatctattcccatgtaaatccaaatacttattctttatttcagtaattcttaacttgaatcatagactttggaacgagttagggaatgctctgttgcctaaaaagcaaacctacaagtatgttggtgtgtgtatgtgtatggaccagtttgtttgtgtgtgtgtgtgctcattttgaggggacaaggatctctagcattcataacattctcaaagaatctgaccaaagaaaggtaacaactatctttgtgtattttatgactgtgtgtgtttgcactcattgcaataaagtaggacaaaatgattttgaaatgcatacatcttttcagcttcctgtttcatttttacatcctcagatacaaccatatcaaattggcctcagttgttcatcagtgaaaatgctcagtttggggtgataccacataaatagcagctttcagatgactccccacattgggtccagaagttctttcatataggctgaatataataaccatcctatatacagagctttatggaacacatgcagtttttatcgtccaagaacccctcaagatgtgtttggtaaatgctccaaagtcttacagctagaaaaggacaaaaccaggattcaaacccagggtttcactttctaagtttatttattcagtattctagactagaatctggggatacaatagtgaacaaaataaactttccctcaaagctaccttctgtttccatttgctgttcctttcacaattcatccttgagacctgaaacctaaagcactcagaactgatactctagttcattatcatatcagttccatttctagtaacttcagaaaaacaagaccactttcaggcctatctgcccttttaagttctgataggtctgatgatgatgtgctaaccattttgatttgtgtgtcaaatctaagcaaagaccatgtttgagtattgtctttatgaaatgacatttcggtaaattagaaacaacaataggcttgtttagcccttaaacatgttgatgaaacttttcattttcctgaaagaattatagattttggaaggtcctcttctatattatttttccaagaaggggaaaacgattcttacattttgctgtaggaaagtgtggcatgttacttcttatttaattatccaacttgccccccttctctgtggtagcatttttaatgtagtacttaaggctgttgtctcttaaaggctacaggggcattttcaccaccactagtataactttaatattatttactatatacagcatgagcaattataaaccctgaaggtaatagtggaaatgtttgaggatacattgaaatagtctctcaataatggggagactgcattatgctttgatagcaagacattttggaaaccattacaactctgtgtattttgtttcattaatgtaattacataccatctcttccacacacaccccagaatattatacatttttattttgcccaagcctgtttcagtcatcagtttgtagtcttttacttccacttgtaacttgataactgagtagaacaggggtttgctagagtatatttccctgtgcttctttaggtagttgactatgctattaagataacagtatttgcttactgataactcgagaaacagtcattttcttggtctgtgctaaattgcatctcttccagtggcagcttatttctttaacttttttgacatattaagattttaatcatggtaatactgaaattgtttcaaatttgaaagagcgaacctcagtaacttcaatgaaacaaatgggtttgtgatttctagccatgttaaatgaacacacaattaaaaggaaaaccattagtggtgcaaagagccctgtgctggaaatctcaaagtcttgctctgccacttttaggggccactgtagtaataataataatcaccctgtctacttcacagggttgttataaaagttgtcaatgataaaatggatataagtgagttttttaatgtgcagatcctttatatatttaaaagggatgttatattttacccactatatacatagaaaaatcatgcccagttatgacttccaataagaatttcaaccaaatagaatctctatatgtggatgtagtgcttgaggtctgggtcactagatggataaaaaccaagtgtacatttttttatattctaccaccagtcctgagcacagcactttgcctcagaaggttctgattcaccaagacttactacatgggaatagactgatttagctcaggagctccttttaatgcaaatatttattttgcttgctgagaacaaaggattacagtgccaataactcaagaaaaggagcaggcaagccaggtctgtagagagaaaatgaactggaaaataaagtaattctggggtgagtttgatctgcactttaattcaagtctcagaaccacgtgacatatagtgatcaaaatatactctcaattgcatattaggccttcctttggggacctgggctatttattcagcactgtcccaaattaatagctaaatgactgagcctcaaatttgccgagcccgtgtaatattggtataaatttggcaaggaaagcaaatgagaaggcaggcaaaggggtgggtgaggggaagcttgctgaagctcagtatctcaaagtgagttgtggatgcgtgtttaacactataaagaaccagtccattcttacccatgagttttattgctttctgggacctctaacccaggaccacccctgattcaccaacttctccttcttctcctctttaaatattatagttcattgtgatatgtttttcctgtatctgctctatcatgtgacctcctttcgcctgggagggcagattttctccttatctcttccatccatgtctgttcttagctaagagttccagcctcagtacagctggattaccctttggacagaagggcagacaacctcaaggtcagcagcaacagaagttgggcctagtagtcagatcacaagtgagtgtggctattcatgagaatagggtggtggtggcatttatcctgcttcccctccataaataaacctggtaattttatttttaatgttacaaaaaaagttgatgctacattaaatgttttaccctcatccattatcataaatctcatactggaggtgtgatctctcttcttgtttctttaattgaaagtaccaatgaatcgaggcctggtggatgatgcctttagagttttttgttttgttttgtttttgttttcttgaatcattgaaacttgtcatttttatctagactcttccacaaatggcaaagtcacttatctgcagaattcccagaatcttcttttgcctttgtgcacctgctaattaccccctctgaactgaatttgaaaaaattaattaaaataaccgaatcacccatgtttttgttcttgcagggtttggtgagttatgtggattaaaagaacagactatcctctctctttttttgtctttcttctccctgtccaatactgaggaagaagagggagaagggggtaaagatacataaggcttaactacccagggttatgaaaacagtttgcaaagtcttcctgtttgcttcccttttggtttttcttagtccctgtaggaaaaagtttacccctctgtgtgcgagtgtgtgtgtgtgtgtgtgtaagtagttgagtgaaaaagaatgagactgacttaaggagagtcaatatcgcatatgaatcaaaagccaacatttagctattagatagatctcagtgaaaggatatgttcaagctaagttgattaagtttattaaacttatttattaagcttgactaagcttattaaaacttctgctaggttgaagccattagtaaccatctgtagaagataacagccatgagtttcacaaatacagcagcagtgtctgctagaattgtgctgtgagccacgaatgcaaaccacatatgcaattttcaaattttctagtagctaccaaaaaggtaaaagaaaaagatgaaattaattttaataatgtatttgacttagccttatatatccaaaatgatagcatttcaatatgcaatcaatataaaaacatgaatgagctattttacatttttgtactgagtcttcaaactctagtgtgtattttatacttactatacatctccagtctcgaagtagccacatttcaagtgtataagagctgcatgtgagttggctattgtattggacagtcccattcctgtttcctagtattgataaagtcttcctaccttccttcgttgttatgggagaaaatgtaaacagaacctgcctattacacgagagctgcaatatttccccaaatgcagcccagcagtaccatgagctgccctgtggaaaaatttaatctgtgattaaataagttaggaaagttttattattttacccccttttgaagattacatggtacattaacatattaaagattgagtaaactctcctgggtaaaaaaacctgtttgacgttgtttagttgttgagttctgtgtctataagaatcctagaaattgccacaagtgtctctccataagaaaaactttgtgttttcctctctttctccactccttttggggcccatttctatttatctttgtattcagaatcacccgagagccacaatatctcttttgttctagaacaaccacctcctaaattgaaaccaacagatggctttaaagtcttgcacttggacatagatcttcagaaagtaccaaaatatataccttcctcttattctttcagaaacggtgaacactctaaaaagatgtgggggtgtggtgggggatatgtgaatgtgtatatgtgtaaacaccaaatacatacagtttcttaagtagagtaatgcaattcttgctgatgttttatttttatttttatttttttatttttttttttttttgagacggagtctcgctctgtcgcccaggctggagtgcagtggcgggatctcggctcgctgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaatatttttatattttgtgtgtggtgacaatgtacatgctttaatgtgtactgttctagtaatatgtatgaagtagctgtgacatagcagtcagttttaaagatacagactataattgactactgtcaatctttaacaagtgatctttttgcaacttggttttagtggggtctctgacgttgtccccacaagtttcattttaaaatctatgcttaagtggcagttaccaatataattaattctgctgctgaatttggttcatattgaatgtggtaacccttatatgtggatatattcaaacatgtggattgatttagatcatccgttttgtctttgttttttaggactttgctatttcaatattaaagatgtcttttgaatactgtagcagcagtagaatccctatgttcttgaaaatgcaaaatgtaacatgagttgcacatagactctctagcagtagaaatggaatattctaagtgcagaagtttggttttagaatctgttaaggaaggacggcccaatctttgaaaaggtacagctttctcaactttgaacatctgggggaactcttcttggaagtctgaattttaatatctttaatccaatggctctaaattaacaaacattaaaaaatggatttcgtagaatcaaattattagggggagcactttgcaaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtacaaagaaatactctgtcaatatagtataactgcttatttcaaattgtatctaggaatgaataactactattatttaaagtactactgaattttgaggaactgatcaaagaattagtattattaataaaattgtactatttgcaatatatttgccttggcacaaatgcagagttaaaaacataaaattataaaaaaaaataatagtgattggttgttactactttaaaatcctactaatttccattagcactaaatcaaacagcacttatctgttgtatacaagtaaaattttgaaagactcggacacaaaatgaaaggctttttaaaaatgtctttgccataacaggttatatgacctcttgctaattgttatatttccttaggggcactttgaggctctttcaaagacatctgcagcaattaggtctaaatttagagtagaatattttgccagatattttactatatcacaaaatgtcatactactgtattttataataaaaccaaattctcaagtattctggtatgttacatattaatataccaaaacatcactttctataagtctattattatgtacataatatttttaaaaataatgggtattttggtcctagtgaaaaagtataatgcaatacatgacattaatctttagtcaaaacccattgaggtgtctgacagggaaattagcaatcataagctataagatatatattattttcaaggacaaaatggcaaatgataatacagaaagacgtgatcactggagcaagttagctggtgtgcagactaagaaggatcaacttgcaaatgctcatcagaatttagcttttgttattggttgttctgcaggggatagtactagtcagttgatattgcttccctttcatgtgggagtttgctcacagcccactgcatggtataatgaaatctctataagcaagatagagtcagaagcttagagatgcactttatggtttttacaactgctgttacaatgttctaaacactgtgatctttccaaatgtgttttctgtattcgttttgtactgtagaaaataattcgctataaactggactttatagtgtttaaagcgatgttatttattggcttattgcccctccttataatacatttatgtacagtacacttaatgtaaaacctgtgataatcctttgccttaaaataaaatctaatgctaaatattcagtgtcctgattaataattctaagctaccaatttttcctttaaagctaaccatgatgtcaagtaaaacattacacaaatactctgtggagtgttgctgctgattctgtatttgtggcagtgtatgtatcttggcccaggacatggtggccttctgggttctataaatagacattagtaatccttttagggaaagggcctgctacctctcagctgctggctgaatctgccccttaactcataaatggattttctcatgccacataaaaaacagaaaaacagcccaccacattctctccctgtacctcttttttggtttgattccttttgaatctttatattctatttgtgtttacattattttcctaaatagaaaaatgccagagatgcctgaagattgaaatcacccaatttcaacaggggaagagatcttataattatttaagtctaatccctttatggaacctgagtttcagaaagatttagtgacttgatcgaggtctgagggacgggggtggactgagtacatcctgatatcaagaagatggtggaaagttcaatgggctaaaaggagttgtgttagtcttggtattggcacaccaataagcagaggtctgtcttggaataaaaaaaactacttccttattaggccctgatctttgccctgaattacttacagttacagaggaatatattttgtaggcagtttttctgggaggtaaggacaggttcctagagacgatctttgacgccttttcaccactggaagcaatgcttcagaccactgtatttggaagacaaagggacatgctcacatggcacagtgaaaagtgaaatcttttcccacttggtggtgggtgcatgacaatatacttgcactttgaaaagcctctgtgtggtctggttatttttaaaaggccagaaatgctggccctttgaagaatcacgcgtttcctcggcccagaaaatagactgggctagaaaggcgcccggactccaattctgggcccgggtggttgcagtttttcaaagggatgtgaacggtttcccaagataggacccaagggactctaggacccagaggctgcgcgcgacgcccgcagggcgaactgcatccttttgagctcccgctccatggcctgagccgtcgtagggcgcgggttcgcggcccgccaggggacggtcaccacagagacgcagccggcactggcgagcgagcgagcaggcggcgcacggagcgcgtgggcgtgtcccggcggggctgcgcagctcgccccaccccaccccaccccagccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgcgtgcagaagcccagagccagccccaggccgcagcctcggtcctgtagcctgatctccccacctgctcgagtggagggaggcggttttcctgtggagacaggtggctgagccccaagccggtccgccatgcccctcagccccattattccagtcaggaacgcgacgaatcatggcataatggttataaagttggggcacactgaattcctgttaggttccgtcaaatgaaatagccaacattcaactgaaattgaccaacaaaaatggcagtttcttgtggttcaacctcattaaagacattggtttctctggggtcaagtaggctctgacaggattggcttgtgttgtcacaaacccttgggaagtgtgttctaagctgtggttacggggacagcatgtacaggtgatttaattttaatttatcaaacacatggagcttactgtgtgccaagcactgttctaaaagctttaacagtatttaattctcatagggaagtcaagaaatccatgcaccattcttttctcttggtggcgttacgaatattatgggatatggaaacatatggggttctagaaatgtcttccggccctggcaaacttataaacgtagccattaaagctggtgcacaatgcaccatgaaaacaaaacttgctgtgtgttaagtaaagaaaaactgttggtgacatttctggaaattaatttttattaacacaaagcaagtagaaatacatggtaataaaacagactggcttatctaaggagtttaaaatgtgttgttttagtacctttcatcactataggaaaagcaaaacaaaggccgtccatttggattagaaataagtttataatactgaattttagacataggcgacagaggaatttgaagagatggaaaggccagagagacacctcagctgccagaaaattcagctagccctaccaggaaatctctctctctctctctctctttctctctctctcttacacacacacacacacacacacacacacacacgcacacacacacattgaggagcaagataaattttacaaagttataatttttttttttttgagacaaggtcttgctttatcagccaggctggagtgcagtagcaagatcatagctcattgcatcctccacctcctgggcacaagtgatactcctgcctcagtctccagagtagctaggactgcaggcaagcgccatcatgcctggctaattttcttttttctttctttttttttgtattttttgtagagacagagtctccctatgttgcccaggctggtctcgagctcttgagttccagtgatcctcctgtctgggcctcctaaagttctctctatgttgcccagtatggtctggaactcctgagctgaaatgatcctcctgcccaggcctcccaaagtgctggaattacaggcatgagctaccacgcctggccataaaatttttgcacctcatattaaagaaaactgttccagctgacacacaaactactgacttgtagtttgcacacagtcacagcaaacttggtgaacaaatttctcagcctccagaagctgcagaatcctagaaaggaaaataaacaggtacactggcaggagtgggaggttgctgctgacttcttgatagctggggaagagtctggggaaaaagaaagggagggaggggaattttaaaagtcctgcaacctggagccatttagtgaggagagagttagtccttcctagccaggtaagccctgtggtctggactgtattcttgctcagtaaaataagtgtgatctgactttgggcagggcacttatcatttctttctttctttctttctttctttctttctttttttttttttttttttgagacggagtcttgctctgtcgcccaggctggagtgcagtggcgcgatctcagctcactgcaagctccgcttcccaggttcacgccattcttctgcctcagcctcctgagtagctgggactacaggcgcccgccaccacgcccggctaattttatttttttgtatttttagtagagacggggtttcaccgtgccagccaggatggtctcaatctcttgacctcgtgatccgcctgcctcggcctcccaaagtgctgggaccacaagcgtgagccaccgtgcccggccttatcatttcttaacattatctgtgagaagaaaacagataatgtttaagtggagtaacaggaaaaaggggaactgacatttctcaaaagcttcttgtgctagatggtttgatatgtacttacatgcctcaattcattgaatcctcaccatgacatagacgtaattgtccccattttgtaggtgaagaaaatgaggcctcagactatgttctcaagcctccttaaaaagagctaattatattccctatgctcagtggaagaaagcagaggactgtgtagtacattctattagtagttccattttaaattaagaaaaagtttggtcatcttggcaatccaataaatgataataccctatcattgctgccatttaaagtgtttctaaacacgaagagtaacccaagacaaagctaatgacataatatatataaaaacaggatgacaagtataaacctgaactcaaggaaacataccaagatgttaagaataataatttctgaatagtggggttatgagtgataatatcctggaaaatatataaaactatataataaaacaattatctacttttctatatttttcagtttttaccataaaaatattttaactttattaaggaaagaaaacttttggtgctttgaagagataacttctcagctatatataaagtttcaacactataaaaagacctatttccagaaagttctgaatgggccattgtcttcttggagcaaaaacaaaataaaagataaaaaacaaaacaacaggcaaaccccttccatcaacaaggagtcactgattctaatgcagctgatttatttcaaggagttattggacccatgaccttagagctgagatacaaaatgtggttccaagtctcttagcttccagattaaaagaaaagcagtttgttcttgtgtattagcctgacttaatatcttactggaatttcttcctgctgactgtttgattctgttttaactctaagacatcagctttacataaagataaaaattatttccctcaaacaaaggagaggcatggtgattcttacccccttccttatggattggatttaataatatttctaaattgttttttgacagtttaactcttcttgcctttggatgagtactagccaaactcgtgtttttgctaggtagatgctgcgtttgagttcatgcagcacgatggcccagttaaactgcaatacattacactaatgattctggactaaatactactaactaggctttgctccttctttcctttagggaggcatagggagagcaccatatttcatttgtatcagtcttgtatttaaaatggtagttacagtttttatgattgttttcacattaagcctgagtttgaatgatacgaactttggataatgccttgaatttatttataattttaaggaaaatcttattgcgcattataatagatactctagcaaaccagagcagggaaaagatctcttacctaaaacacaaaaacattttaaaaattctgtttatcattcttttacatttatgctaatttttataaattaattgggaggaataaatataaatgagttacaatttcaaggaattcccctcatttcttttttattactggtatagtgaggaaaaaatggtacatgaaaaatctgagcttataaaataaaggctaagaagttcccgaaacctttccagaacattgcaaaatgattcaccatagtatatctttctatattaaactttataaagaatttaaaatattaatagtctacatttgaagagaatttttttttcatttgcaaggtgcttttacatacagtatttaatttcatccatggtaaaaccctgtgagttaactgtcattatcttatttttacagtccaggaattgaggttcagtgagattaagcaagtggcttttcaaaggttttgcagcattttctatttaaccaatttgggttttgtgtaggcttacagagcatgtgtgtcatgtgaagataatgtggcttattggaaattatagtatttctttggaaaaagtattttaattagggtctctggtaccacagattatttatgctcacatcagcatgcatgatttcagctaaggaataagctccttctgctatgatacttgaaaagtgggatatatgatgcttgaaaatgggataaagtaaaaaataaggatcaacctactgattatctacattggggttagcaaactgtaccccacaggcctaatacccccatcacctgttttagtaggtaaagtcttattggaacacagcgttgctcactggtttatgtactggctacaactgctttcacattgcagagacagacttgagcagttgcaacagagaccatggcgtgtgaatcataaaatatttacttttttataaatacttcacagaaaatttgctgtcccttggtgtagatgatactgaaaaactaccttgagtattcagttttgataaaagtatctaatttctggctttatttagacctctcaagcaacaaacaaataaaaaaccaaaaaataagaacagattttgagtaattagatgagtcttgcagaattccaagaatagtagtttgtttcttatcagttttcctaaccaacagtggcaggaggtcttggggccttttacaaatgtattaaacacctatgactacatgtaaaactctatgctaatacaaatgtatcacctgggaaaaaacagtggcttacaagaggttccgcctgagctttaggaccttctttcatttccatcaactgatcatggaagttttactttgtctacaattctgcagaaagcttccagtttcatatagccccttccttcgcatcaagaaaattactttctcctctgaaccctcatttcgttcattcagttcttagcatatgctggtatttaatttgtatgttttagtctttcaaaactctaagcttgattttattatgcaagtaaaacattttttgaaatgacagaagagcagaaaacagatttgcacaatgaggaaaataaaagctctcatttgactgctcagacagaacaattcctaatgtttttgttgtatatctttactaatatttttataatggtatgctagtaaactgttggggaaaacaagccctgattttcagtgtttgctgatttctcaaatgcgtatattctcatcatgattgatcaagctaccagttgtttaacaactggctcacaaaattcctattttaacagtctgctctcttgagtcagtatgagccagctcaaacatttcactgtttatatgtatgtgtgggtatgtgtgtgtaatctgtatatattttttatatatgtgattttctttttacaaaaaatggaatttaaaatatatgattctattgtaatttgcttctttcacataccaaatatggtaaaaatacgtagcctggtcaacatagtgagactgtttcctcacaaaaaataaaattagctgggcacagtggcatgcatctggagtcccagctacttaggaggctcaggagtgagggtcccttgaggccagcagttggaggctgcagtgagctatgatcacaccactgccctccaacgttggtgagagagtgagactgtcttttaaaaaaaatttatatattggtatatgtacttctataccattgatgttaaggaatgtataatgtttcattgaattgatatattagggtttatttaattattctttcatttttgggacctttagagtattcccagcattttgctattatacataatgctatgatttaaattgttgcaatacgttttcttctaagtgagatcatacgtgataacatgtcataactaaaagtgctatataaatattaattttcgtttattattattattattgtgcatatgtcccactatcccatttagattgtgagtgcccccaaatgaggcaggggtatccagctgtctgcattccccacagcacttagtaaaccacacccgcattcatctcatatttgagaataaagatgattatcagtttattctgtttttgttttgttttagtttgtttttttgagacagagtctcgctctgtcacccaggctggagtgcagtggcgcaatcttcgcctcttgtgttcaagcaattctcctgcctcagcctcccgagtaggtgagactacaagggtgcaccaccatgcctggctaattttttaatttttagtagagatgtggtttcaccatgttggccagactgatctcaaactcctgacctcaggtgatccgcctgcctcagcctcccaaagtgctgggattacaggcgtgagccactgcccccggccagttcattctgttttctaatctttgatgtgatcagtggtccaacagtgtaaagttgctaggcctcatacagtcctcagtcattaatttgagttttccttcagagaaaattcaattggacgtgcttgggattgaactcatggcctgaacttcattgacattatttccaactgaaaaaactggtctgtgtggttttacattgttttcatgtaatatattaaagtgttcttgaccccatgggacaaaatgtcgtacacaaatcaacccccccccacacacacacccacacacaccatacaccttctttctcctagcaacaaatgaacaatggtattaatcacaaaatatgtccactttgagctcaccagaaaggttcctgcatttcctctcttacatcaagctttattttattatttcaaattataaatacattccagttgccgtagtcacctcaggatgagagtataaagttaacattataacataaacattcaatgaaatagattaagccattaaaatcttctggcagcatcataaggttgttataaaagtgcatgttagaggagggacaaaaagtcctttaacaagttacaaacctacggccatgaatatttttcttactcctagggaaaacacatttttaaccagcattttattatgaaaattttcaaacacacagaagacaagtttaaggaattctatagtgaacacccaagtactcaccacctagattctacaattaacattttgtttcacatatttatccatctatcaattcgtgtgtgtgtgtgtgtgtgtgtgtgtgtgtgtgtgtgtgtgtgtgtatgtacttcaaagttaatcacagacatcagtattcttcccacttcagcatccatatttttacctagagaggaaatccaaattttaaaagccaggtattctctcagtctggaaaagtcactgattaagtctgggactgactttagtcccgccctgtaaggacttatgaaaacagagataggtaacatgttgtggtctcccagtgaaatgctagatggcaagctgccctgtgctggaggatttccgagccatagcttctgctttaactggggtggtttggggcatcttttggatgtggaacacacacacgtgtgtgcgtgcatgcatgcatgcagtcacactatataatcaccatttttcacagcaatatgacaaagtgggtattatatctgctttatagtggagggaatgtgctggggtggggatagtaggtgactcggctatggctacacagctagtatgtgtcaggaagggaaactgcacattttttctgtggctctggagccggaaccactttccattctctaagagatttccttgcttcagtggcctttggtattacctcttcatttggttctcattcaattcccattggcctgctggaaagcatcaagaggactgcatactgagaactggtccttggagtagttgatttagaagagtgactatagttcagagtagccaagtcaaggctttaagaatcaggctaaaggtaagtaggatgagcatggaaagtcagaatcctgtctgtctctaattattatgatttcctgatttgttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtacgtgtattttttatttctgcctgcatttggggatcaaaatgagaagcaaaatatgcagtttattttgtttcaaaggaaatttgttcttaagtgcacttaattctgaatctgtgttctagttactatgctcaaaactcaattaaaataacaacgtttattttgcttatgactctgcattctaggcagggctcaaaagggttacctaatctgtgatccactgtggatcagctagggtggctcaaaggtagggggctagaatctattcaaggccccttcactcacatgtcttgttgttcacatgttttgatattggctgttgctgggagtttcagatcttctccatttgatttctctgtgtgggtgagtttgggcttccttatagcatggtagctgcttccaagggtgagtgttctaagaaggagggaaggccagatggaagccacatcagcttttgtgatccaggcttgggagttgtgggacatcacttctgcttccttctcattgttgaaatacttacagagttctgcccagattcaagggagaggagagggaagcaaactctgactcttgttgtggaatggtagagttctagaagatcacctgggaccaaaaataccactgtggccatttttagaaaatacagtttaccagaggctgaaaacacagctactggaggctgcttctcttgggatttcactctgtctttcagtgctagttctaaactagttgagacagttggcttaacaactttgtggtgaataatggaacaaggccactttcctgtcttcttagacttgtaataggtatatcagtttataagtcaagacaatattctacctttgggctattctcacatcatcaaattaagagcagattttggttaagttaaaaaaaaaaaacactatttgcatcagagtcaagattttaatgaaaagcctacaaatgagaagtggaaacaaccccctcccaagtattaatattatgggtaaacgaaaaccattatggtaagttttattatcggtatacaaaatgatttaaaagccgtaagttgaaaaaatacatgtttaagaaaacattgaagataagaaagactcttatttattttacttcactcagttttatcctctttctgcctatgttttagactggctagtaataattcatgtcagagtcacaggatacttacatgttagagccatctcccttatccaggttgcctgattatgattcttaaaatatgagtcaggatcttaagtagagatcttgaaccttaatggatcaacatttatatgtaaatactttccgcaacacctggtagggagtaaaagctcaataaatatagcaacatccgtgttctctaaggaattataactggaatgggtcttgaccaagctgcatgccactatactctttttcctagtttattgtttttccaagtggcagggatacagcaagaaatcagatgtgatgatagcctatttgatttttagaggtagatccaatttttttcctcaagtttttttagtgaagattgtctcacagttgaagggttggcaaactacatcccatgggcctaatctgggcactgcccgtttttgtcaataaagttctattggaatgcagccctgctctttcatttatgtattgtctgtgactgttttgggactaaaacaacagagtcgagtagttgcaataaacataatgtggcccacaaagcctaaaatatttactaactttttacaaagaaagtttgccaacccttgttataatttttcagacataattctgttcaggaaaaataaaatctgtcttgtaaaatgtcagtgtcacaagggatatctgaaatgtcccaaaagaacttggaaaaacagaagtcctctgagagttaaatgataaatcaaatagatatggaaaaaggaagtgggcatggtcttgttaaaaagatagatggctgccatttatgcaggtcttgactaaccccaatcactgccttaacatatataaggagggaatatctcacccggaaagggtaagacccttatgaatggagcatggtctagggtgtgccacaaaggcaaatgttggtagtgtctgtcatgtggttagaaatgcatttggtgcaaggaagaaacacctaactgtaaagttaacctagagtttatttttcttatctaactggaaattggaagtagacagttgctgacagtatttcagctgctcaatagtggcaaagttgatgtccctgccaatccattggccttttgcttgggttgctactgcatttccaaccatcatagctacattcaaaataggaagaagggctgaagaaggaagggtagatatatttctctttttattaatgaatatagctttttcataaatttccctaatagactttactttgtcttcctccttttattaaaaactatagcttttccagaaatctccctaacagaaatgactttaggtctctgaccagaactgatcagtcatttagcttaaagggatgctaggaaagccaggtctaggaatgtttgccaccaatggcttagactaatattcctcaaacttccctgatgatgatgattagagttacctgggggcttgttaaatatatagattaccaggattcatctctggaaattgtgatttgctgtgtctgggatgggagccaaggttatgtgttttctttttatttcccttttgttatttaaacaagggctccaggtgattttattatcagcaaagtttgagaacattggattagactagtcatggcctgcgtgtggttgggcccattgccacccataacaaaaccatgttctcttaagatagtgagaggaatggaaaatgaataggcaactgacagtgtctgccacatcatctaaatgcagtccagatgaatagaaatgtgtccctcttgacagaaggacatagagtccatcacaacatgaccctattcagcattcaaattctgtaactctctcctctctctctgattctgtgctcattgagcaaacattgatggatttggcattagcagagtttgccatgagggagagaagggagagccagctacatggtcactggagagttattgtttttcttcattgcaatataattcatataacataaatttcactactttgggtgtacaattcagtaggtttcaatatattgacaatgttatacaatcaccaccactgtctagttttagaacattttcatcacaccaaaaataagtcccctattcattaacagtcactcttcatttcccctgcccctagcccctggcagcctactaatctacttcctgtctctatggatttgactattatgaatctttcatatcagtggaatcatatgctattgggaagttttctttctcatagtcagtgaataacggacactgtgtctgtgagcttcagtcttgggtgaatttgggcatcctgagattccctgagtctaatcagttctcagcaagggcttgctcaagtctccagatcttggaggatgggttgggttgaagcctaagtgagcataccaatgttactgtgctttgtgaaggcccctgcagcctgccatttggcttgcctggccctcacagtgcccttctctattctactcaaggtggtaatgttggtagtaaaaatggctgtttcatgaacccttgatttgtgccaggcactgtgataggcatccttgtgtttcattttcagtgtccctgaggtagataatattatctccatcttagtaaagagggaaattgagccagacacagtggctcacacctgtgatcctagcactttaggaagccaaggtgggcaaatcgcttgaccccaggagtttgagaccaccctgagcaacatggcgagaccccatctctacaaaaaatacaaaaattagcagggagtggtggtgcatgcctgtggtcccagctacttgggaggataaggcgggaggattgcttgagcctgggaggaccttgcctcaaaaaaaaaaaaaaaaaaaaaaaaaagaggaggaaaattgtacttatagtcagatagaggagccagaatttgaggttagatttgtgtgactttatttatggactcaatgagtatttcttgggtatgttctgtgtttcagaccctgtgctggtctctgaggataaagtggtgaataaggtaggcaggccccaatcatcttcaaataggatatataaacatcacacaaattattaatcaaatgcatattttatttaaggtaaatcctgcaaagtgaaagataagtagcctctctgagggtatattgggggttgtctaaccgagtctgggaaatgaggcaaatgtttccaaaacttagatttaaactgaaaactgctagatgaagaaaagaagccaggtgaagaaaaatcaggaaagagcatcccaggatttcaagctttattccagaggcaatgggaaggcactgatgagttttaagcaacaagtgtcatgatcaaatttagttttagaaactgattactctgcaaaatgtatttgaagagagtgaagaaacaaatggagaggctaggaagtgggctactatagttgtcaaggtgagaataatggcctggactggaatagtcagagtggattattggagcaatattaagaatgcgtaagtggaacaatgtgatgattgattggatatgaaggtgaggcagtgagagatgtcaagaataattcccagttcctgatatggactgctgtagccatggatctccatttgtcttggtagtgacaggtttgcgaggtatattttactttcagttccagacttaaagaaatgaatacattttaaagattctatttaactcatgagagaacaagcagatgttctcttcggaccagcttataagataacccaaaggacagacataggaatattgactagagatatcaaaatgaatatgtaaatggaagtaaaactggttttattacagcatgggggggtgacatttgaacctctactgtacaagacattgagcatgtctgttagtgacttatagcttacagaagaatgtaaatgagctcactggcaatacaaagctagaatcagagaacctggattggtatactgaagacaggacaatgttttgattgaaacacattttttttgttgttgctagaatgtttaagtcaagtacaaagttagactttcctcaaaaagacggtccagttattagggtgagcaggttcctgtcagaaacattttgaggccgggcttgatcagggctcagtgaacaccaataatatcacaaagttgaggttgtcttgaaggcagctccctgaccaaggagggcctggagcacagtgggcgggaataagcactggtacctggagaggctcaggctagtgggaaaatcgacgagggctgatcaaaacaaaactcaccaagaccatgtgaaggcaaaaaggagccttagaaaggagattcttccctgctccacaaaagcctagctgcagtttcctgttagccacatggacggctttctgcgaggtcagtatgcccagtgcctgagctcatccacacctgttttcctggttgttattctctagtatctgatggccaacatcctggagcaggcaggcaagaaggcccagaacaattgcagggtgcgcatcacaccagaacacatagagagggccatgcacaaggataagcagctcagatgcctcttggaggatgtacccaccatcaggttgatgaggtgccccagcccgagaaggagggatgcttgggtctgagaacctggcaggacttcatcaacaatttcatccagcctcaaaaattcccatagatgagagaccccaggctgctgccatcagcccatgctattaaagtctttaatgacagtgcccctgacttctctcaggttctctcattttgggttggaggtgtccttgagacatccaggagaagctatcccatagagagctgaatgggtggaaggtgttgccagtgtggggtgtttgaatcagtgattttagaaggggcagtttccagtggttggtgagagcactggccctggcgggaggagctgactggggataaagatatagagacttcctcattggctttgaactggaaggccttgtgaggccaggtagttgctgggagcctcctaggcttgataaattcctaacctgatgctgggacctagggtggagctgcagactctgactgaggtgcgggaggctttattcagaatagcaaaggtctgaagtcagagggcagtagccacagggatgggtggagagggggcacactgcatactagctggcatgaacttcatgggacaggctttacatggagattgaggagtgatggggaaaacataaggaaaaaatgcaaaaaaaaaagttatggtcatgttattttatttatttatttgtaccctgcctcattccaaaagaggacttgagacagggattagtaactggtactatgacacattgtttggaatatattcttctgtcctcttgtggacactgttaaattaagtagtaacattatataaaagctctctggcctaggacatgcaatccaatcagttcttaatggttacaaaatattacaaaacttatttgtaaatgtattccattataaacacaattatcaatcgcattcccagaaaaaataatctgtgtatgatcatgtatttcatagaacagcatagagttatcaatggccaaaaacaggttcaaaaggtatagaaataacctatgtaattctgtcttgagtgatggcctctaaagcatgtactgtacttttaaaaacttgtgctctgtactgtttaaaaaaggtgtcacatcaagtgttgtagcaatctgtccccttgcctgtgaatgtccatattttaggttttcacctgttccttggatcctctgtggccacattctgctgcctgttggccagatgctgcccagccagattcaataacagatcagacaacctgggtttgagatcctagttcaccactttctggccatgtgatcttggactttcatttactcctgctgggcaggtttgctcatgtgtaaaatagcagagagtccctctatctttagttttcccaaagattgagtccactttggatatgcacagtgtggcccttaataagcagctgcatctgtctcctcccctaaccccagacacgcaggcaggcttccccagggtacatctgggtctggttctcaggttactgttgggcacttgggccactggctgtgagagtgacatcctgctgagccctatggagagacaggagagtgcccagcagaggaaggagacagcggaagagggacacgagccaggcagtccccactctggtgtccctttttctcctcctgccttgtgactcgccctctctctgcctctgtctaagcagaaggacccagcttggcctttggctaattcacaggagtgtcctgagaatgaaggaaatagcggttatgtgtttaaaaactgggctgtgagaaacccatgtcctggacacaaagatgtttcacttcggccaggggagggggtgctgctgttgccatgaagtgatgagctgaaggagactccccacctgaagctgctggagagaggcctgcttgcagctcaaatgcacagaagaggaagcgagcagctgggctaaggctgggagtgctccacggcgctccctaaggaatcatgcagtggtggggtgggcagcttgacaatgaggtgcctggaaatatgaggttcagtggacatgatatggcaagaaagacttctgggatttagacaagcacatcttccacatggccctaaggacaaccctgacagtactaatctctaatatattatttcctaaagcgcagtctacaaagtggcatcttacaactcaatctggatggcagataggtttgctagttctaagcagacatcttaaaagaaaattaatgagctggtagcatttgaaaatcaataacattttacctgaaagtctggatttctggctctcttgagaagtaaaaaggagggtacacatgattacagtcacatagagatgactagctactgcaccatgaagactgggcctctggtttgccacattccttccacactcttccctataaagtcccatatctgattcacttcattaatttatagtagttgtctgattaatagagatacttgagtttgttactctcactacaagttaattctaagttcacagtactcagaacaatcaatctcatttaatgaagtagtatattgtgcattgcttctcaaaatatcattggggtaggaccagtagtagcaaacttccttgtttttcttgttccagtaaattgtgaactgatatgtggttgtattactagtatgccactcatatttgacttgtcatttgagtttaacaactgcactggtatataccttgttcaaaaagtgagcccactaatttaaatgttgtggctaaatcagatgctatacagattcctaaatgccagctctcaatgtccatacttatcataactgactggtaacagatatttcattgtaccagtcctcaaactttttagatttagatttagattttaaatctaatgaaaagcagtaaacaggacctacagttggtattgtttctccttcagagtcttcatgaaaacagatttatccttcttatatttaggactttagcataatactggtgaaaatgttgctgaactacttctgttaaagcaaaagatattaaggaaaccaattagcatcagtggggcatgttagatgcggcagatgtgagattgttgagttctgaaatgtaggataaaaagaattcaccaaggcaactgtgaaagggagtcttcatgaaaggagaggcagaactgggttctggtctcctacagtgtagtttacttggggacccatcagtttccagtgagaaaaatggaaaaattatttcaaaactcagctagagatgtgtacttatgactgtgctcttttcctaacaaaatagttctatggaaaatgggtaaatagggttcagagtacagggtctccattttacagctgaggccactgaggcccagtgatagtaatcagctcttataaagtcacatggtgagtgggcagcacagtagaatgatggcctggccttccttacctgttattggggctctttcctctattgtatcctgaaaaaggggtctcaaaagagaaagtgtttaatgttctcctctgagaaaaagaagctaaagtcttcaataccaaggtgttagggtctcttggatttcttgggaagcactcaataactcactcccaagaatattcacttgtgctttatttgggtaaggccagacaggtcaggagaaaagtgctgattttatagtataggtctttggactttgcaaacttagattttgttccactggacattgtattaaactgtgttatgaacacaaatttgtctcagttaaggtgttctggaaattctgactctgtccactaaccattatcttaaatgtggtgatgtgatgtcatgagaagcctgtgttcaggagcctagtctttgaagtacctgaggtagtgacgtttttcatggtgctctaagacaatccttctttgctgaagacaaaatctccctcctgtagctgattgtagggtcattagggaaacatcagtgtaaataaaaaactatctggagagccaggcatgctggctcatgcctgtaatcccagcaacttagaaggttgaggcaagaggaacttttgaggccaggagttcaagaccaccctgggcaacatagtgagacctccgtctctacaaaaatattttaaaaattagctggatgtggtggtatataactgtagtctcagctacatgggaagctgagctgggagaatctcttgagccaaggagttctgagctgcagtgagctacgattgcaccactgcactctagcctgggccacaaaatgagaccacaattcttaaaaaaaaaagtatcagccgggcgtggtggctcacgcctgtaatcccagcactttgggaggccaaggcaggtggatagcctgaggtcaggagttcaagaccagcttgaccaacatgatgaaaccctgtctctactaaaaatacaaaattagctgggcttggtggtgcatgcctgtaatctcagctactcgggaggctgaggcaggagaatcgcttgaaccctggaggtggaggtggcagtgggccgaggtcacgccattgcactccagcctgggcaacaagaatgaaactccgtctcaaaagaaaaaaagtatctggagatgatagacacttaaagtgcctgtggttcacttatgacttgtgataaagtgaaaagtctagtggaagtacataacaaacataatacaactgaagaagaaattgtgacatacaaaataagataataaagccaatgtaaaaaagttttgaacaaaacatatgtaagcataatgattaatcctattttgaagtaagtctacagtagattctagacatctgtattttactatacctccataaaaagatttgatgtgtatcctcaatttaaaaagccatgagggaagatgcttcataaaacttaaaagagaagccaggcgtggtagctcacgcctgtaatcccagcactttggggggccaaggcgggcggatcacgaggtcaggagatcaagaccatcctggctaacatggtgaaaccccgtctctactaaaaatacaaaaaaaaaaaaattagccgggcgtggtggcgggcgcctgtagtcccagctacttgggaggctgaggcaggagaatggcgtgaacccgggaggtggagcttgcagtgagccgagctcgcgccactggactccagcctgggtgaaagagcgagactctgtctcaaaaaaaaaaaaaataacttaaaagagaaagttgtgactagatagttttagaaatctactgaaatgatgactgttaacactataattttattgcctaatattatgaaggaaagcaccagcaggactatgatcattagaaacatactatggacagtgggggcactgacaaatctctaggaacttctcatacaatctagaacttctgaaatatttatactaataatatatttcatattcagatttaatctagggaaggctgagtacctcttttctttttttctttttctttttctttctttctttctttctttttttttttgagacagggtctcactctgtcacccaggatggagtgcagtggtgcaatcatggctcaccgtagcctcaaactcctgggctcaagccatcctccccactgagcctcccaagtaggtgggaatacaggtgcacactaccatgcctggctgatttttttttttttttgagacaggatctaacttatgttgcccaggctgaagaacacctcttttgattttatttttttccatgcaactcatcaatactaacagcaacaaagctaattttatctaatatctgtctttttataaggtgaaagaacaaatctttcctattttctaggtactctgttggaaatctcaaagataagtctaagtgtaaaagatttatagagtttcattttatttcatttaaaattttgaattttattttgaaaggcaaaattgctagaagatttgagaattaagttaggatcatgagtgactgagtacatgaatggttgtagcttggctatctattaattaaagtgacagtacaatgtttagataaacatccaaaagaccttgacacattcttaatgcaaattttttttgtttttgaagagaataatcaagggcatgataaagtcagggaaaaaaagtgttattgtggtaagatgccaaatccctacttttaggataggattacataggtaatattttaggctaaattatgaccccaaagatattcaggttctactccctgaaacctgtgtatgtcactttatatctgcaaagggaactttgcagataaagagattgaggttgggagattattgtattgtaggtcgtgcaggtgggcccaggacaaatgttctttttttttaaaattaattaattaattaattttattttattttatttttattgatcattcttgggtgtttctcgcagagggggatttggcagggtcataggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccccccttaatccatttaaccctgagtggacacagcacatgtttcagagagcacagggttgggggtaaggtcatagaccaacagcatcccaaggcagaagaatttttcttagtacagaacaaaatgaagtctcccatgtctacttctttctacacagacacagcaaccatccgatttctctatcttttccccacctttcccccttttctattccacaaaaccgccattgtcatcatggcccgttctcaatgagctgttgggtacacctcccagacggggtggtggccgggcagaggggctcctcacttcccagaaggggcggccgggcagaggtgacccccacctcccggacggggcggctggccgggcgggggctgaccccccacctccctcccagacggggcggctggcctggcgggggctgacccccacctccctcccggacggggtggctgccgggcggagatgctcctcacttcccagacggggtggctgcgggtggaggggctcctcacttctcagacagggtggctgccgggcgcaggggctcctcacttctcagacggggcggctgccgggcgcaggggctcctcacttctcagacggggcggctgccgggcggaagggctcctcacttctcagacggggcggctgccgggcggaggggctcctcacttctcagacggggcggccgggcagagatgctcctcacctctcagacggggcagcggggcagagccgctccccacatctcagacaatgggcggccgggcagagacgctcctcacttcctagatgggatggcggccgggaagaggcgctcctcacttctcagagtgggcagccaggcagaggggctcctcacatcccagatgatgggcggccaggcagagacgctcctcacttcccagatggggtggcagccgggcagaggctgcaatctcggcactttgggaggccaaggcaggcggctgggaggtggaggttgtagcaagccaagatcacgccaccgcactccagcctgggcaccattgagcactgagtgaacgagactccgtctgcaatcccggcccctcgggaggccaaggctggcggatcactcgcagttaggagctggagaccagcccggccaacacagcgaaaccccatctccaccaaaaaaatacgaaaaccagtcaggcgtggcggcgggcgcctgcaatctcaggcactcggcaggctgaggcagtagaatcaggcagggaggttgcagtgagccgagatggcagcagtacagtccagcttcggctcggcatcagagggagactgtggaaagagagggagagggagaccgtggggagagggagagggagagggcaaatgttcttataagggagaggcagcagcaggcttgatcacggaggaagaagacaatgtgaggagtgaaacaagatgctgcactgctggctttgaagatggagggaagaggcaggagccaaggaatgcagttgtagaagctggaaaaggcaagaaaatggattctctccttgatcctctggagggaacatgcccctgttgacaccttgacttcagcccagccaaactgatttcagacttctgatctccagaactgtaagacaacaaacatttgttgttttaagccactgtgtttgtggtaatatgttatggcagtcataggaaacaaatttacgccaaaagtaatcttttacaacctcttattaagaacagaccagtactccaagaaaactcattttcacagaaaaactaattctagatttgtttcaatgaaatatttgcttctaaataacccactatttacttttgacagtctcacaaataaacccatcaatactgagccagatttggcaaaatgttaacacaaaattgtgttcctttccagactctttctgcaaacctcctacaactttctttattcattcaggttttatccttcaccattcttcctcattcctatcctggaacaagtcatttttctttagaacagaaatatacttttttgcccataataaaaatttcattatcttgagattcctagtaatctcattcacatgtattaattataacttttaagcagccccttgtatttcacaaagaaaatgaaggagtagataattgtgaatttctgtcattttagcagcctagccaatctcatgaatatacttcactgagctttatccagccacatacttcccttatttaattccacagtgtggcagaaatgaacatgttcatttacagacccaaagatagagcctctttgtagcatgtacaaataacaagcaatagtgtataaatgaaaactgtacttactaataaatttttcagtattctatcttacttagaaatgatctagaaagccagtgaatggccaagatcttcagttatctaaagattttggaaatgctcttcagggtaacatactacacaacctcattactatggaactataaatttatcagaacaatgattcaagttgcttaaaaatagatttaagtttttaaattattttaaatatttaacaggagtaagtctagctcatttgatcaaaaagctgtataagtttaggagaaacatactcaagagtataaaaatatatgcttgtattaaatatgacactgataaatcagagatgtttacattaaactcaaagtcttaaactagtcttatttgccaaagagttacataaattatagaagtctgaattcttaaaatggttttgagttggtttctaggataatacattttttaaactagcacatttaaaaatcaatagtacaatttccgtattttaggaaattctagttatattcaatttatataagcagttatttttctggatatgccaatcagaatagaactcttttaatttgggagagtttataatctaatatattagtactgtgcataggtaggaaaacattacacactcgtacaatcagaggtgaggatattacagacatatagacatacagatagagagaaatagagtttgtagcttcaattcttcaatttcaggcatggatcaagagtgaacacaaaatcagaaaatctcctcagtccagattttaatagctcttttcctctcaaagggcatgaaattcttaagtgatttgagcttagaaaaataaactaacaaaaaggatgacaaaccagactttctgttgcctgtcacccaatagggactagatttctgtaaaccatggatgcacttagatctccagattgttagaccttaaaattggatttcaaaccatttctctcaataagggggagtaacttaatggctttaagtgaaccagaacaaaacagaaacacaaaatttgtagagagaggatttcaaatgagaagtcgagggtgtcaacaaagctctactggtgctctggattcacctatgagagcgaagaaaggacatgcttaggctttaactgctcatgaggtgcacttccttgtcagcaatgtttacctgactcttacaggtgaatctattggacatctcattatgacttccaaagttgttaaaatatatttttcaaaagggtaaaattatgttgctcatacagatgtgaacctgttgttgtttacttgtaaggaaatgaacagatgttatggccgggcgtggtggctcacacctgtaatctcagcactctgggaggctgaggtgggtggattacctgaggtcaggagttcgagaccagcctggctaacatggtgaaacctccgtctctactaaaaatacaaaataaataaataaattaaataaaagagaaccaacaaaggattgtttagagatatcaaaataagtatgtaattggaaacaaaacttcttgtatgacattttgagagggaagacagttgaacctgtattgaacaatgcattttgcagtatgtatcggtgacttgtcagatagcctatatcctggagttgaaaaataataagaccagcaacaacaacaggagttacatcgccccacagaatgtggaaatgccggtgcacaggcctgagtgccaccgattctttaggggtgggacagtcagtctaattgacatgtcccaattcaagaagaattgctgatgcctgggttccagagcctggcaggggtcctcacagcctcatccttcggcaaaaccactcagttgaggaagccccatactgttgccatcagcaaattctctcaaaaagtttaaatccatggatgtgtttctgactcctctcagtttctgtcatttttagttggaggtgtctgtggggcatctaaaagaagacataccataaaagatttttaagatttagtatggaggcaggaatggctgtgtagcctggagagctacataggctgatagcaggctttggatgctctgagccgtatgtccatgcagctgtggtgaaagattctgtgcacgttgccaatatcctatctcgagcatgtgtcgcagcacacactgcagtgtttctcttcctttgtgcctcaggtctttctcctctggcagggaatgcagctcaggtactgatgagaagtgtgggtaaggtaatgcccatggggccacccccaaactaagggagatggtagttgatggataagacttcagcctctctgtcctttagatggataatttggggtacaatttacacaatcctttgtggatctccagtgggaatgagccccatttgctatagtggtaaccagtttaaaaatgtagtcttgattagccttgtttcctcccctctcccacttcccacccaactccttcaattctgctttctaggcttacctcccaaatgaaccacctgcacccggatgcttgcctcaagctcttcagtttgagagtagtcatctaaatagagatgataatttgaatcacagttgtctaggcatatgcagctgtgaaaaagacagctaggttcatccagggacaatttctgtcacagatgatgtgacagaattgaagggtaagcatgtttgaggtttgtgcaagagaatgaatgaagttttacaccaagtattcttagctagaagtgggaaaatagaggatttatttcactggagggtttggtaaaaattaaaaaaaacaattgtagtagctcttaggcaagcaagtcagatggatagaaggtggtggtcacgatagggtgtttgaattagtgatttcagaggtgtttattgactcttggattcctaggaaagcactcttaataactcaatcctgcaatttcacttctgctgtatttgggggcaggctgaataggctaggattcataggtctaattttatactacagttctctgaactttgataacctgatgcaatcatcttctatttgatcaggtcgctgcccagagatctactttggccagacacgttgactagattctgaaaaaaccttacttaattttttgctgttttctggaccaactgtattttatgaactaatctaatgataatagctttaattcatatattcttagaggaatattgtgaggagggagttgaagggatagctttttatgtttgtatgtggtgctttacatgatataagcttataaacttttggcacaacatcatctgttttttgcatgtgtgtactcacacacatacacagaaaacacaaaatttcagaaagtatgaagggaaatacactggaatatcaattagttgtcctgagatagcgagaatatggggtactttttttctttccatttatctgtgtttttcatgctttcacaatgagtgtaagtttttgttgcaatggagagagtgattcatcatgggctactctgggtggctgtgggtctttgttttgctcgtttgtgcatgcccagttctggcacatatgaccactcaatgtaaggtcagtgaatatgagttaggcagggaagttaaattaatctcagtttcatagacgaaaaaagtgagggtatcatttgagatgttttcattgcaagtgttagaatatgcaactaaaagcaatttaaaattgtaaaaatgtattacttcatataataagttcagaggcagagtgatcctatggttgactaacttactagcacaacagtgtcgaggatccaggcactttccatctttttatctgtcttccttggcttcttattggtgtctcccctgatgattgcaagaggaccatgtatccattatgtatttctgcataataaaccaccataaaacttagtgacttaaagtaatagcagtcgtttctcttccttatgattttgtaatttgtgtaggtatctgcagggcttaccttgctccatgtggcatcagctgaggcagcttgactaggggctggcaatttggtactgtttaatactggttgcttagctgggactgagggctggaggccttggttgttttccatgtggacctctcttggcttttttacaacatggaagctagatcttaagagtgaggattccaagagacatgaaggagaagttttcagtgtcttaatatgttgtcctggaaaccagaatcatttttgcttgatcctattaggagtcacatgatctcagattcaagaagagaagatatagaccctacttgttgataggtggtatttcataggacttcaggagccatgttttaacacatctacaggtagttttaggtctagacattacatgcagacatgatgaagagggaggtttcttcctgtgtacttctttttactgaggaagaatgcctctttttttttttttaacataattctattcagtttccgttagccaagattgggtcacatgtccatgccaaaccaatctctaggtacaggaatagaaaacgaagttacagatttctctgaggtgtagatatccttgaccctacagaacagctgggcaaggcctggaatggatagaccagcttcatcctcttaacccaatgaatactaattacaaatagtataatttttgtatttgtctgtgacagagaataagttaggagactggtctatactaatctttatttactccagtggtcaaacctgggatcatcttccttgaacacatggaagggtgagcagtacctaatcagaattagagttctgcctttaaggaagaagagaggaaggataccaattaagttggagacccaccgtatctgcaacactgaggtttaggaagtttaagggcccaaagccaagactaagacccagtttttggacacttgacccaatgttagttgttttaaccaacactgcttctcatggagttggagaatgttagaggtagaagggacctaagagatcatcatgtttgattttgcacactctgtagaaaccacttattcagtgtccctgaaaggtattccaccagcctctgcttgattatattcagcagtggagctgtcagtattcaaaagacacttctattggtgaagtactccttgttagaaattatttcttatataataagaaattaagtgggacttttccttttcctgcagaaatgacatctggcccatgtgctgaatatattacattcagaaaaaaaaagccactaaggactggccagtcttcttctttcagaattttctgagagtgacaaactaacactaccacagtcaacctcacatacccctaccttccaattctaaaaggacttacctggggagaaagggcagaagagaataggatcttctgtaacttatttatggtgagaggttacttcctcccttccagaagccacttaaaatagaatttcaagatgaagggtgctagcaacaagggtagccaagccactccctggcttacgaagctgggaacccataggcctatctaacagttgctcaccttccttagagatagcttgttgtgtgtaccctggagtttaggagtatttataagcatagcgactgaggcctgcttttcatttgtagattcctgaaggagggagacttgagggaatagcctggagtgaataaagactgtggtgccatatgcctggaaagggggtgagaggtctctgctgtatcagctagctattgctgaaaaacaaaccaccaaagacttaatggtttaaataacacatttattgttgctcaatcgtctacagccctgttggtgtgttaggattctctagaaaagcattatataggtgtatagtgtgtgtatatatatatatatctccaaatatatacatatatgtgtatatatatttccaaatatatacatgtatacgtgtgtgtgtgtatatatatatatttccaaatatatacaaatatgtgtgtgtgtgtgtgtatatatagtcctctttgctttatcaaatctttacatgacatatttgctttagatatatatttttttcctttctaagcaataaaatttatagtatagttggggcaccctgtgagtcttccttgtcatgatttcagagtttatcattcttgtgcatgatttataactttgctgcataggcacagtatccataaataggatatattgattttgtaggtctttaaactttatcacactgcaaataacattctgaaacttgcattttttttcagtcaacattatagttttgagaactatacacattgatgaatgtaaacttagtttattcatttttgtggcagaaaagtgttctattgcagggtggccaacctttttctgtaaaggtatggaagaaaaatattttagattttgcaggccatctatggtctgtgtcacatattgcaaatccaagaaagaaataacttgtatatatctgatagtagattggatgccctggtacttttttcactttattggcttacatttctaacaacaattccatttaatggttttctgcaccagaggtcattttcagctatagtcagtatagtatacatagctgctatagcaacctaaacaatggtccatatgattgtgtaatggtgtatgcttattataagattatattaagtctacaagacttgaaggtgggttcatattcattcctcctaaattaaacccacctccaaatgggccaggggggagaatgcttccatccacccaccaagagttttcacttaggtttggctttggcatgatgtcggctctgattttttcctggagtttgtgaccacaagtcaatggaagttacttagtggtacacagcgggaagacatatgcctcctacccacctccacacaagggtgtcttgtcaaggctgtgcctgagtttagggaaacgtgtaactgctgcttatatagctatttgaataatccaatatccagtatagaccttctgattcctcacccacatctctgtaaagtaagtaggtcttggtagtgctgcatagaattagaggcactgagcaggtataatcacacacagaagaagtgatatcctcacaaggtccaaaccatttattgtttattctttatatcctacctgtttctaaaaggctttcatgttgtttacaaccatggacacataccaaacatgaccataaaataagaagaacaaaaaataaagtatttgaaaagagggaagggaagatagattgggaggaaaagtacactgaggattattgtggtagttgaaaagattagtggaggtaagaatgtgcatgcaaatatttgtgagtgtctgtggttcaagggttggcaaagggaaaaatacaagaaattgcttcagtcatggaggatctaatggccatgctgaattatttacaaggttcactgtacatgagtagctacattttaagaggatttgtgatgccttgccctacctgaaaatctgcagtagaatagagaaactctatcttgggattctgagtggtcttgctaccattttgctgttagataccattttgctgctaccattttgctgatagagggccccatacatgagtctaggatcttacttccttgatctggctatctaaaggaagagtttttttgtttgtttgtttgtttttttggtgtaactcaactcactgatgtcccttttctctgcctgaggcaggatgataaggaaggaggacaagttgctagggcagatagagggatctgcttctgccccacttctctctgatcattggttattccttgagaggcaattctcagaaaccagcttagcatagtgaggcttacccattcccgggtgcctgaccagcatgatttcagaaggtctttacatatgaaatattcacataatagaagacagacgtgaaatttgggctcagtggaagcaaggaagaattggacaaatcctcaaagtacgcttggtggattctccagactccttagggtcctgggcagttttaagggtagcagactccttcctgccatcaagtgataaaagagataaaatgtggagctgagaccactgctagggaaatagactaattatatttatttaggcagaagagcctactggttaaggctacgattctggagcaagactacttaggttggaattcctgctctgttagctgagtgatctctggaaagttacttaacatctctatgtctccactttctcatctctattatgaggataataacagtatctactttataggattgttgttagaattaagtgattcatacctgtaaaattcttacaatagtcccttgtcatgaattaagagtgcaataattttttgcataagaaagatgagctggaggagatcttgtcatccaggtacttaggcaagaaatcgaaatacagctgggagaaaagaacaaaatcactcaggacctctgaggattatagagtatacagttataatcacatcatgtgggttgtgagtgatgggccatagtatttgttctcacaattctgagaacaaaacaagatataaatatgtattgaaggaagagtcctcaatttttgactaaacatctggtaaactggcagatgttcaagagagattttggtaacagtgagatcttagtcagtaagactttaagaattttcttttaacagtactagggtatcatactggttatatctgcagaatgagttttgctatagtaatctaaataggggtttatgtaatgtctattttctacttggcattttgccagggtagggaaaaatatctctgaaacaacttcattgtaacaatgaaatgatagtcctttttgcctttaaaaattgtaatctaataaacatttatcgagtgcctactaagtatagtaatagtgtacctagttttttcaaatacatattattattgaagtataaagtacacacagaaaactatactcatcataagggcaaatcttgatttatcacaaagtaaacttactcatgtagttctgtatccaaggtgagaaacaaaagagtatcagaatccccaaaagactccttatgtttcttttcagtcactttcctcacccacctcccccaaaggtaaccactaagcagaaagccgacttctcacactacagattattttttcctgggttttaaaattttatgtaaatggaatcagggttctggtttctttcactcacactgtattcatgaaagttatccatattgcagtttgtaacagaagtttgttccttagcattgctgtataggattccattgtatgaatataccgcaatgtattgatacagtctgcttttgattaatatttaggttatttccagattgtgactatgacaaataatgcttctgtaaatatccttgtgcgggccttttagtacacatatatatgcagttctgttgcatgtatatgcaggagtagaactgctgggctgaaagcaatgtcaatgtttagcttcagtagagactgcaaaggcagttttaccattttacactcccataagcagtgtatgagagttccagttgctccatatccttgccagcacttggttttactttttgtgatggagtagatgtatagtatctcattgtagtttgaatttgcatttatgactaatgaactaattttcttttcatgtctttagtggccattttaggggtatgtttgtgtgtgtgtatgtgcatgcatacacatgtgtgaaatgactgttcaggtattttcgctcattacaaaactgagttgtatttacccttttggtccttgttcataccttcttgtatctccatgcttccacataggatcatttcttgtgggcctgaaatactacttttaacatctctcctttagtgcagatctgctggtgacaaattccctctcctcatttttgttttgacagaaaatgtatttcttttcccttcatctttgggactgtgttacttcctacttttagattatcattcatcttccagcttccattatttctgttgagatgctactgtcctctgtcattattgttactcgtttgaagttcatctgtctacttatactttctgactgcttttaaagactttctctttgactttggtgttcagcaattttaacatgatatgcttagttgtggttttcttcatatttacctacttgagttttgtagcatttcctcaatctgtggtttgatattttagcagtttgagaaaattctcagccttcattgcttcacatattatgtcagagccattcttttctctctctttctctctttctctctctctttttctctatctgggacatttccactctactgtaagtttttcatgctttttctttctccatttgagtgttttcttctgacctaccttctagtgagtactaattatctttatagctgtatctaatctgctattaaacctgtttatttcttaattgtaattatggtatttttttagttctagaattgtcatttgagtttttaaaatagtttccagtctctgataagttcccaattttgtcacacaattttaaaatcatataaattatagttattttaagtccatgtcagattattacaaaatctgtatctcctacaggtctatttttattatctattattatttttggattttggccattttttgttgttggcataccatgttatttttaatttaatgccaggtatttgtaagaaaaaaactagagaaaatttgaggctctgcatgaactatctttctccaggaagattttgcttttgtttatggcagtcagatggactagatgcagatcaacttgactcagtcatgacttgagatggttgaaatctatatcaatctttgcgagggcttaatctctttccagtcatccttactcctgatgtcctttgagtttctactagaaagctttgggtgtacaccaggatcattatggggcctgaatgtcaatatttgctcccatacccaccagctttgagagatttctataagttgtattcatattatttgtttcttagtactcattttcatttgggaaaatgtcttgagggaaaaggcagcttcagaattttctcgagagattttttttttctttcaaaagtcttagccccaggagtactcactgctttggaagatctctgatgcctttgaacagatgtttgcctagttgttcttgacagaaataatggattaaacaagctaatctgccatgctagtatggaaatcttttgctttttgatgccttttttagggaattcaaaaagcatgagaaaataaaattggacttttttgtcattttaaatgtttgttgatggccacaaggctaattactgttttatcctttttttcttttccttttttctatcttatgaatttcagaggtacaagtagttttgttacatgaatttattgcatagtggtgaagtctgggcttctacttcttccgtcacccaaataatgtacattgtacattaagtacattaagtacaatgtacattaagtaatttcttatcctttaccaccctcccaagtctccagtgtctatcatttcacactgtatgtccatgtgtacacattatttagctcccactaagtgagaatatatggtatttgactcttctgaattggttcacctaggataatggcctctggttccgtccatgttactgcaaaagacatttcattctctttttatgactgagtagtattccattatatatcgcattttctttatacagtcatccattgacagacacatagtttgattccatatctttactattgtaaatagtgctacgataaacatatgagtgcaggtatcattttaatatggtttatttttctttgggtagatgcccagtagtaggatttcttgattaaatggtagttctgtatttagttctttgagaaatcttcacactgttttacatagatcttctattcattttacactcccaccaacagtgtataagtgttcccttttctcccatccttgccaacatctgttatttttattacttttttataatagccattctgactggtataaaatgatatctcattatggcattaatttgcattttctgatgattagtgatgttgagcatttttaacattttattctataatatatatttggtctatgcagatctggcctttgaattctgacacactttttgggatacctataggacaatgtgaaatctattataagtttgattcatagttaagaatgaaaagcaaccacaaaatatatacaaatggccaatacccacatgaaaataggctggaaattattagtcatcagggaaatgcaaatcaaaatcacaagatacaatttcacacccattagaatggctagaataaaaaagttagataataagaaatgttgatgaagatgtggaaaaattggaatcctcatagactaatggttgaaatatgaaatggtgcaacctactttggaaaacactatggcagttccttcgacaactaaacattacgttaccatattacctagcaactccacttctataaactcaagagaaaagaaaatatatgttcacacaaaaatttgcacatgaatgttcataacagcactattcacaatagccaaaaggtagaaactatccaaatgtttatcaactgatgaatggaccatgtcttgtatatccatacaatggaatattatttggccataaaaaggaatgaagtactgatacatgctacaacatggatgaaccttagaaaccttatggtgagtgaaagaaaccagtcacccaataccacatattctattatgttattcatatgaaagtccagaatagggaaaattttaaagataaaaaatgtatcagtggtttcttaggaccagtgggggcaaaattgatagctaaagtatatggggtttctttttgaggtgatgaaaactttttaaaattgactggtgatggttgcacttatatgcgaatatttaaaaatcattaaattgttcactttaaatgtttgtgaattatagcttcattattatagaaatttttcaacatacaaaaagattgagaggatgttataatgaacccccatgcatctatcacgtcttcaacaattatgtgtttttaccaatgaaggattttttttaagatgcagctgacataggcagattcatacactaggggaaaagagtcaggattaagagagtagttgaaaatttagaagggaaagatgataattgatacagcaaagtttttgaggaggcaagtgatagagtgtagtgcaggtggggagatcccggctccagatcgtaagaaagactctttgttcactgagttgaaagaaaacagataaaaattactgtctctcagaaatctgttgaaaattctaattttcagaagcttgctttgctaacttcctccagtttccctctgccactgcactccatatcccctttggcttcgccagttacctctttgaagtcattcactaatttttttgaaaagtctattccataaaagcatttcatgagttcagtcattttactgaagattcaatgtctacagagagtaatcataatacagaaaacaaccatctaccatcctccatcttacagccagactctgttatttctctaaagcaacagacacactgttcccttgtactataaatagaattgctttcctaagaggaattctggggaagaaaatattctccataactttacatagagattaagtttttggtggcaagtcaggaaatgaacaaatccatgcctagtgacaattaatttctctgtgaattaggaaggttcatctggaaagagttcatttggctggaattgggtaggaggaagctttagaagtatgccaagggtttgaaatattgccaaagccttccttttagctttacttaaagtaatgtcttcccttctaataataatgaaaacagcaaaatgcctccatccatacacacccctaggaaatgagattaggattactaggggatgttagacttctgtgaaatgccacttaaataggcagtactgccaatttatccccttttgtgttggctctgtgaagataaggttgggaaatattgtcagggaacttttctccatttaagtctgaatcagtaggtatttgcatgagcatcattctcatcgttcattagatgacagcttaattatagagctggaaatgtacattggaatcattttgtacaagcttcttgtctcccaaatgtgtctccctccctgaccccatttctatctgtgacattttgtagtgagcacccaacagtagcaatgataattaaagccaatgatttcaaaatattttttatgcattctcagaaggtttctgtggttgattactactagacaccaactgggtaataattgcctaattctcttgatagagaaaaagatgtaatttggaaataattgactgaacaagagaaaaatggatagatactagaaaaaattatgtgggccatagtattgcttaaagcaataaatattttggagttaaaataccataaatataacaatataaatactgtacatgtgtgactacttaccttagattgtaataatttatgcttagctcatcttctgcacttaaaatatttttcttatactggagaaaacataaggactatgaaaaaatgatttaataatggatccttagagtttggaaatttgtaaccacacatacatgtataagtaatatacaaagtatatcactaatatgttctgctttacaatgctccattgaattagcctctcaggaaaaataacttagtgcaattacttcccagtcaactcaggtaatggtgtttctaccttttaaatttgattagtagattccagtctttccagtgaatgacatcattaattaaactcagtgccaaaagactatgagaaaaactgatgctttgagtaagagtgagcttctctcccaggcaaataaataccaaagcttcagagtttttatgtctaattatagatgtttttccatttattcgtaaataggaaaaacctttattcctatacattttaaattgtacatttagatagagacaattatgttacatggacagaattacatagaattgaattttaagaatcaagcatggataaagctacaacaatcaagacagtgtagtagtggcaaaagaacagacaaatagatcaatggaacagaatagagagcctataaatagacccacataaaaacagtcaactgatctttgacaaaagaacaaaaacaatacaatggagaaatgataatttttaaaattctagacacagaccttacacccttcacaaaaaattaacctgaaatggctcacagacctaaatacagaatacaaaactataaaattcctagaagataacacaggagaaaatctaggtgactttggatttgatgattgctttgtagatacaacaccaaaggcatgatccataaaagaaagaactaataatctgaacttcattaaaattaaaaattcctgctctgcagaagacgctctcaagagaataaaaagacaaaccacagactgaaaaaatatatttgcaaaagacttatctgataaagggcttttatgcaaaatgtacaaagaacccttaaaactcaacaataagaaaacaaacaatcaagtaaaaaaaaaaatgggccaaagaccttaacagataccttgccaaagatggacaagatggcaaataagcatatgaaaatatactccacattatatgttatcagggaaatacaaattaaaacaataatgaggtaccactatatacctattggaatggaatatcatttaggcttgaaaaataaggaaattttgccatttctcaacaacgtgaatgaacctggaagatattatgctaagtgagataagctagacacagaaagaaatatactgcatgatctcatttatatgtgtaatctaaaaaagtcaaattgatagaaccagagaatcgaatggtagttactaggggcaggaatggctctgggaaatagggtgatgatggtcaaaggatacaaagtttcagttatgtcagataaataagttctagagatctaatatacagcatggtgactgtagttaataatacctgaaatttgctaagtgttctcacacagaaaaggtaactatgtgaggtgatagatatattagcttgactatagtcatcattttacagtatatatgtataacaaaatattatgttgtacactttaaatatattggcaaaaatccagaacactgactacagaaaatactggtggggatgtggagcgataggaactctcattcatagctgttgagaatgcaaaatggtacagtcattttggaatacagttgggaggtttcttataaaattacacatgctcttaccctgcgatccagcaaacaaatcacacccattggtatttaccctaaggagttgaaaacttatgcccctccaaaaatctacatatggatgtttataacaaatttattcataactgtcaaaacctagaagcaaccaagatgtcctttaacaagtgaatggataaataaattgtggtacatccagataatggactattattcagcactaaaaagaaattggctgtcaagtcatgaggagatatggtgaagaaaacttaaatgtatgttactaagtgaaaaaagtcaatctaagaaggccacatattgtatgattccaactatataacattctggaaaacgtaaaactatggagacaataaaaagatcagtggtttccaggagctggagactagggagggatgaataggtggagaacagaggatttttacacagtgaaactactctgtatgatactgtaatggtggctacatgtcattatacatttgtccaatgtgtaatgtccaatgcacccataggatgtacaatgccaagagtgagccctaatgtaaatgtaaactttggatgataatgatctgtcagtataggttcatcagttgtaaaaaaatgtaccactctggtgggggatgttgataatgggggttgttgataatgcttgtgtggggtcagggaatatatgggaaatctctgtaccttctgctcaactttactgtgaacctaaaactactctaaaaaataaagtttattaaaatgaataaataaacatttcaagatatttttaaaaaatgaagcagcaggcatggaagggtattatctcaattttatgggtgagaaaacagaacccagagaggttgccattttttcagtgtaaactggtgagacaagaaaaaaacgagagccaggctgtcggttcctaactcatagccctgcttcccatccttccttgtgccagtatttagagatgttggcagcctgtagtaagtgattatatttcagttttgaccacagtctacttatgggttggcatcatatatcttagatagtacaactcaaggccaacagtgctgtgctctggaatgtaataccacgttccatttaaatgagctacatcttgtctccccaaacttctgcttctattataaactggataaacccattacccataagtcattttaagaaataaacagagttgaaacttcttgaaacactaaggactttcagcccaagacagatagactctcagtaacagtgaagttctcgtttcttcagctccccacagaatttaagaatgcaaccacagtgagtattctatagtcagtgtatcagtttaaaagatcctgcagatatagaggaacatactgagcaacttattactgtttgtatatctactgctggtatgtgctgagggacatcaaaaggaaatatcagatttggttggtcggtcttgattccccagaagcttagaagccaattgaggaaacaaaacacaccatgtaaaggactctacatattcagacaggcccagatgaggtcaggaatgtattttagtgtgagttaccctgaagcaggccctacgagaagaatttgagtgcatatatctggggaggaagatgtaaggagtgtggaagaagagaaatgaggcagggaagggaaggcagccaataaagggagacaactattagacaactatcaccatgcgtgactagaagttaatccaaagagcaaatactaggaaatgtcatagaacacatgcctcagagatattctctctgatggatggggaagccatagtacttgtattccagctcctaatctgggctggaattggggcattgagggcgctctcgggagtattaattcttggcacttcagcctgacaggcacctggatgcagcagctttctgcagttctggaaaacatactcaagcacagtgggcagatgctaacaactggaagtcaggctgtgcacataaaacagaagagtccaaggaatgcgggtggggtgctgacagagtgtctgctgcagtaggattcctagtggaggtgagacttgatgatactctctcttttctccccaggtctcctcatgaccatatccctgttgtccattgtgtatggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaatttagaagataggtgagcaacttgagtgatcccaaaccaaactaacagtgctggtttgtccgacacccaaagcccacttcacacatttataaggacagagatttggtaactcatttgggtattttgtcagttttaacccttaatatacaggtatcccagctttgggcacatgtatgtccattcactttcaggaaggggtgtcagtactttctttctgtgtggtgaaaacataagccatggtgaactgataatttttgtttttaaattatttatattactgaattggcaaaattacagttcacactgcagagctaggttgtcctattggcataaaacaaaccagcaacttttctcatgtgtttggagttaaaatgtgtttttcagttataatttcaatttttaaatttcttggtgctttgtctaattaattacatcccataacttgtcaggatagttgctccaactgaattgctatcatttggctggatgggggtgaagtatgtcttcaaaatatattgaagtaagttcatcaaacatgtttagacttcctctcattgctggagacagcccagtgtagagattggcacttccctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgtatttcattctttatacaattcttacatggcctttttacttcagggactatttttaaaacagaaattttaaaattgtttcattgtaactgattatagttttataaactcacctggaaattacttctgtaggctgagaaatttgagagtgctaagattcagccttgcagaacaacaacagtccatgaaaacctctctgattgttttatagacatttactccacttgttaaaattacactgctggatactaagattctgttcagttgtccatcagttgccatgcacaatacaaaaaagagaggcaatacacatctcttctagacaaacataaatatatactgattcagaaatataaaacaccaaagaaatggcttggtattaacatacataatcaaatgtaaatggttgggaaaaacatcagtcattaaagggatcatttcagagcatgagagagacatggactgtttcaataattcctttgcttctgaaggtggccttggaatttgcaaagacttagctataggataaatctctttaaaaacagctttattgaggcacaattgacatacaaaaaactgcacatatttaatgtatacaatttgatgaatgtgtacatatgcaaacactcatgaaaccatcaccacaatcaaggtaatagacatattcatcacttctaaaaatttccttgtccctctttgtttttgttttgttttgtctttgtaagacacttaacatgagatctatgctcttaatattttaaattcacaatacactatcgacaactataagtactatgttgtacaacagatctctataacttactcatctaacgtaactgaaactttatatccattgaacaacaacttcccatttcccctaccccccaggccctggcaattgccattctatcctctgcttctatgagttttgctattttagacaccccatctaggtggaatcatgtagtatttgtccttctgtgtctagcttatttcacttagcataatatcctccagattcttccatgttgtcacaaatggcaaggtatcctttttttaaggctgagtagtatttaggaatatgccatatattctttatccatttatctatcaatggacatttaggttattttcatatcttggctattgtgaataatggttcaatgaacactggagtgcagatatctcttcaagatcctgatttcagttattttggatacatacccagaagtggggctgttggatcatacggaagttttatttttttaattttttgaggagccttcatactgttgcccatattggctgtactattttacattcctatcaacagtatacaagtgttctaatttctccaaatccttacttacatttaattttttgtttttttggatagtagccatcctaacaggtgtgaggtgatatttcactgtggttttaatttctagtttcctgatgattggggatgttgagcaccttttcatataccagttttccatttgtatgttctctttggaaaaaggtctattccagtcctttgcccatcttttaattgggttattaaacgctttcttttattgagttgtaggagtttcttacatgttttggagattttcagatatatggtttgcaaatattttctccaatctgtagatgtttttcctttgctgtgcagaagtcttttaaaataaatattttcatgttaaaaaaaactgagtattaacaattatagcattcaagtaggtcaatataaaattatttaatttggtgtttgttaatgttttattttgaaataattttaaactaatagaaaagcctgaagaatagtgcaaggaatttctttataccctttacccagactcacctattattaatatttttccatgcccgttatcattgtcactttctctctctttcttgtaaaccctttgagattacactgccaacgttacacccctttattcctaaatactatgatgtgtttttcctgtgaataaaggtattctcttacagagccacactatagttatcaaattcaggaaatttaatattgacacaatactaatatctaatctaatatccatactccagttaacaattgtgccagtcactttatttgctttcacaaagcttgtgaaaaccatgtgaatcaactcagttctcttctgtggggttgtctttatttaaaactatgagtaagttttaacttttctatgaataatgggagatctacagcagacgttgaagttatttgaagaaaatatgtagatgctatcagtactaactaatagcttaaaaactggaaatttgagatgtttattggcaagctgggtaattctttttcatgaacatcctttttaggcttcaagtgtttgctgtttaatatttgaatctgtagttcactcccatcctctgccctgctgttataactctattttacagtgtttgggcccaaattttaaaagattaggaatgaggtgagttaagtagatattattctgctatgaccatatttctctgggtgtccctcttccaggagactatattttctatgaacatctctccaactgggaaagagctcagaaatctcaactatacattttaattaaatgaataacattttgagcatttcctctttttcagggaaaggcactttatagcagcagagatttgtacagagctggaaattcagaagcatcccaatctctcctttcccaacacacacacacacacacacacacacacacacacacacacacacaaacacacacacacacacacacacaccctgtcagagtagaccccaaatatgctaagaagttgagtctgccacagaagcctgctctagggaatgacctaacatcttatcaccctctctgcatggttgtttctctggaaattattaggccaaggagatctagaatacttggtttaagcaggttttagaatccagagcatctttaaagagtgttacagcagcatgcagccgtgtctctctgctgcaggttatcagaaaacttaacactcagactctgctgtagcatgcacctttgtgtgagggagtggagggtttgcctcctcccaagaaggatagatttagctaaatcaattttgaggttctgcctgtgctttcactccctccctgcctcctatcctgaattaattttctatctctgaatgatgagttcctgattgaaacctgattagcctgcttcctaaagccgtggaaataccatctcccttagacatatacattatgcatactggtttaatttcttatcagtttgcttcctatcttaattacctaaactctacagttaatgagttaggttttcaggggtgatagcactcaagaaataaaacaggattttgaaattctattttggagtggtgctgcaacaccacacccaccgccaccctagcagggaggagaatgattcccttttgtcatcttcccctaacaaggtgaccttcttaattggattggcagaattttctagaaaaatggtgcctggctgtagggctgcaggcctccaagaatcagaggtattgtgatcctctccactactacagatatctggcacacacttgtgcaattctttttcaaaccaatgggaatgctgttgtgagtgataggacaggactgattagaagtgtcactgtagtcaaagtaattttgtcatttttctcccagctcccaccatgaacaaatattaaaaattcaaccactgttatgtggagggtgaccttaaagtatgtcttttgtaattgaggttattgggatctattaccctgggaagtttttttttttctgctgaaatattttctcctatggacttatggtatagtcttttccttttaaaatgaggatagatcacccacacatcatgcggcttctctcatttacagcttgattcaagagatcaggaaatatgtttattttaaaagtgtactgtaaatgtcctaccttaaaaaagtacattatctaccttcacaggaagtatgtaatcaaggtgaaatgcttctatcgtttcaaattattactaaatgtatattactatcataatatccatcaaaataatatgatttctacagtcttcaattcacctcccagtttacttccttagccttattataaataatatcagggtgctttcagctacaatttgtagaacacctggttaaaagtggcttaaacaataggattttgttatctatattaacaagcagtttggaaagaggtgattctagattctggcaggcaaactatccttgggccccagaggctttccatctttcctgtcaccttcaacctgttcctccatcttcacgcttgtcttcacattattgaagcatagtaacctgacctccaggtatcacgtatacaaaactgaatctgagcttctccttcttgaaagatggagaaggtcccaagagttccggaaggaggcaaagtggtctttttcagccgccagggtcacacatttcctccagtaccgtgagttacagagaaaaagtcctaatccttctgcctgaatgttgaccttattttctaggtcttagaattctttggtattgctttacatttcatttcccacccctcaaactgaatttattgtgtactttctctggagaactggttccgaaggaaaaagaaaagcaagctttctattaagccctaaagagctaacagggtacagcaggacaatttatatccagacagagcgttggggtaataggagaaaacaaatattatgttcttggagccctggtatcatttgcatatttccaaaggaaaataaatttgatgctagaatgccatctctttaaaagcactcagttcaacatctaatactaattccacaatattaacaccagcaatgtccagtatggcagcaactagccacatgtgactactgagcaagtgggatgtggttattccaaattgaaatgagctctaagtgtaaaacccacatgagattttgaagatttagtataaaaattcaaaatatcttaataatttctacatttgataccatgttgaaaagataatattttggatatatgaggctaaatgaaagatactattaaaattaatttcacttctttctacttttttttactgtggttactaagaaatttaaaatttcccctgtagctcccatatctggtttgtgttacagtggacaagacattttacagatatgtacactaagtgtacaccagaaaaatgccagattagccaagatctgttccttggatggcatttcccttttttcatgtcaggaaaagtgtgtttacaataaaaacaaggatgtctcactctaatgtattatttatgtgctcagagagtgtcctgagcaatgaggagatgttttctttttcttttctttcttcttcttcttcttcttttttttttttttttgagacagagtcttgctctgttgcccaggctgcagtgcagtggctcgatctcagctcactgcaacctccacttcccgggttcaagtgattctcctgcctcaaccccctaagaagctgggactacaggcgcctgccaccacaccctgttaatttgttttgtatttttagtagacacaggggtttcaccatgttggccaggctggtctcgatctccttacctcaaatgatccgcccacctcagcctcccaaagtgcagggattacaggcgtgagccaccatgcctggcctagatgttttctattaagtggtttccaaacatggcttcccattggaatcacctggagatgatggggtcgttgaaaatgctgctgccaggccacacctcaggccaattaaatcagtatctctgggcatgggacccaagcatcagggtttgcatctgggctctccagtattccagaaatctttctttataagcaaaagtaggtgtctggggcttacaacagtcaatcagtcatcagatataagtatctaaaagtaacagaatcactgatttcctcacactgtgttcagatgttcaagtaaatgtagcttctttatatcctagatggatttgaacttccttgtgatttcctgcccgaattgggtaccaaaaaaggtggggggtgaggaaccagccttgctaagcccagtgtccccatctctgctcaccaggtgcgtctgtctctttggagtgactgcacgtctatgaattaagcactctatttttcaggatgcctcccctgcccttctccttccctgagatggcagcacccaggtgtatgggagagacactgcgtgccacctcctggcagaggggtaccaggacctactggcctgaggctgggcccagggctgggtcaggcccgagtttgctcacatgggttcctctgagttctgctggactctgctgctgagctcttcagctgtcagggcctgtcctctgcttgcttccaggccttggcttgggttggtctactgtgagctgcggcccaggagccacaccatggcctcttccaagggcctggactgggcagttctacacaggggcaccatggaaggctctcatccctcagcttcacatcccaccctcccatggatgaggctgtgctcctgggttccacattgcctcaccaaagggccactttctgccctctgtcagcatgaccacagctctcctgcttgggaatgtgggatcagacagcaccccagacaagggaccctcagacagtgcccaatgggaagagacagagaaacccctgagcctctggtattgcctcaaccaatttattgtgtccttcccaggcttagttgtggaggaggctgtcaggatacaggggcctcagtaacagcctccctcttcccacagtctatggatgcctaatgcctcttgctctacttcatagcctccttgctctaggccagcaagcctccagtgccaggcatcccaggttgaagcagtgtcctctctgcactgtgggggcactgtggcctcagccctctaagacttgcttttgatctgctaagtgagagatacacaaaaaataaaaaagcaagaaattaattcatattacaggagaaaaccatcttcactaaaaggaagacaggaaggaaagaaagaaggaagagaagaccacaaaataactagaaaataaataacaaaatagcaggagtgactccttacctatcaataataacattgagtgtaaatggactaaactctccaattaaaagacatagaatggctgaattgattaaaaaaaaaagatccagtgatcttttgcctataagaaacacacttcacctataaagaaacacatacattgaaaataaagggatggaaaaagacattccatttcaatagaaaccaaaaaaaagagtaggagtagctatacttacatcagacaaaatagatttcaagaccaaaagtataagaagagacaaagaaggttactatgtaatgataaagtggtcaattcagcaagaggatataacaattataaatatatatgcacccaacactggagcacgcagatatataaagtaaatattattagagctaaagagagagaaaccccaatacaataatacctggaaacttcaacaccccactttcagcattgtagagacctccaagacaaaaaaagtcaacaaagaaacatcaggcttaatctgtactatagattaaatcgacttaatagatatttacagaacatttcatccaatggctgcagaatacacattcttttcctcagcacatggatctttctcaaggttagaccatatgttaggtcacaaacaagtctttaaacattttaaaaaattaaaataatattaagcatcttctctgaccacaatgaaataaaagtaaaaatcaataacgagaggaattttggaaactacacaaacacctgtaaattaaacaatatggtcctgaatgagtagtgggcaactgaataaattaagaaggaaattgaaaagtttcttgaaacaaataataatggaaacacaacataccaaaacctatgggacacagtaaaagtggtactatgaggaaagataataatagcattaaccgcctacattaaaaaataagggttagtttaaataaacaacctaatgatgcatctaaataactagaaaagcaagagcaaaccaaacccaaaattagtagaagaaaaaaattataaagatcagagcagaaataaatgaatttgaaatgaggaaaacaatacaaaataccaatgaaacaaaaagtttgttttttgaaaagataaaattgacaaaactttagccagattaactaagagaagacccaaataaataagagctgagatgaaaaaggagacattacaactgatactgccaaaatctaaaggattattagtggctagtatgagcaactatatgccaatgaattggaaaatctagaagaactagataaattccataaattcctagatacatacaacctaccaaaattgaaccatgaagaaatgcaaaacctgaacagactgatagcaagtaacaagattgaagccataataaaaagtctcccagcatagaaaagcacagaacccaatggcttcactgctgaattctaccaaacattttaacaactaataccaattctacacaaactatttttaaaaatagaggaggagggaatacttctgaactcattttacgaggccagtattaccctgataccaaaaccagacaaagacacatcaaaaaaagaaaaaaagaaaactccaggccagtatcactgatgaatatcgatgcaaaaatcctcaataaaatagtagcaagctgatttcaacagcacattaaagagattattcatcatgaccaagtgagatttatcccagggatgcaagcatggttctacgtatggaaatagattaatgtgatacagtatatcaacggaatggaaggcaaaaactgcatgatcattaaaattgatgctgaaaaatcatttgacaaaactgaacatctcttcatgataaaaaccctgaaaaatctgagtatagaaggaatatacctcaacataacaaaagccatatatgacagacctgtagttggtatcatattaaatggagaaaaactacaggcatttcctcgaagatctataacacgataaggatgcccactttcaccactgttctgtaaatcctagctagagcaaacagacaagagaaagaaatgaagggcacccaaatggaaagggagaagtcaaattatccttgtatgtagataatatgattttatatttggaaaaacttaaagactccaccaaaaaaactattagaaccaataaacaaattctgtaaagttgcagaacacaaaatcaacatacaaaactcagtagtatttctatatgccaacagtgaacaatctgaaaaagaaataatctcatttacaatagctacaaataaaataaaatacataggaatatagcaaaaaagtgaatgatctctataaagaaaattataaaacattgatgcaagaaattgaagaagatgcaaaaaatggaaagacattccatgtttatggattggaagaatcaatattgttaaaatgtccacactacccaaagaaatctacacatttaatgtaatccctatcacaataccaatgacattcttcaaataaatagaaaaaacagtccaaaatttatatggaacacaaaaagacccagaatagccaaagctatcctaaggaaaaataaaaccggaggaatctcatcacctaactttgaattacactgcagagatatagtaacccaaagggcacagtagtggcgtaaaaacagacacatggatcagtggaacagaatagagaatccagaaacaaatccacacacccacagtgaactcatttttgacaaaggtgccaagaacatacacaggaaaagacagcctcttcaataaatggtgctgggatgattctacatccatgtgcagaagaatgaaactagactcccatctctcactatgtataaaaatcaaatcaaaatggataaaagtcttaaatctaatacctcaaactatgaagctactaaaagaaaacattggggaaactcttcaggacactagagtgggcaaagatttcttgaaaaacacccgacaagcacaggcaaccaaagcaaatatggacaaattggatctcatcaagttaaaaagcttctgcacagcaaaggaaacgatcaacaaagtaaagagacaacccacaaaatggaagaaaatatttacaatctacccatctgacaagagattagtaaccagaatatataaggagctcaaacaactctttaggaaaaaaattttataatctgattttaaaaagggcaaaggatcttaataaacatttggcaaaagataagacatacaaattgcaagcagacatatgaaaaggtgctcaacatcattgatcatcagagaaatgcaaattaaaactacaatgagatattatctcaccccagttaaaatagcatttttttttttttttgagacagagtctcactctgttgcccaggctggagtgcagtgacccgatctaggctcactgcaagctccgcctcccgggttcacgccattctcctgcctcagcctcccaagtagctgggactacaggcgcccgccaccactcccggctaattttttgtatttttagtagagatggggtttcaccgtgttagccaggatggtctttatctcctgacctcgtgatccgcccgcctcggcctcccaaagtgctgggattacaggcatgagccaccatgccctgcctaaaatagcttttaaccaaaagacaggcaataacaaatgctggcaagaatgtggagacaagggaagtctcatatgcagttggtgggaatgtaaattggtacaaccaatatggagaacctagttttctttacagtaggtttaagtgggcttaaaatattcagtaaatcatgctctaagcagatgtgctgtcatctaggctttgttgtttcatttctggagcacaggcagagtagatttggcataattcttatgggccctaggagtttggaatggtaaatgatcattgctttcagcttaaagaaaagaaagaaaatgtggtacatatacgcactggagtactatccaggcataaaaagggatgagatcctctcatttgcaacaacatgtgtggaactggagatcattatgttaagtgaaataagccaaccacagaaagacaaactttgcatgttcttccttatttgtgaaagctaaaaattaaaacaactaaactcatggatatggagagtagaatgatggttaccagaagatgagaagggtattggttggaggcagagagggtgtggtcaggaagaagtggggattgttaagtggtacaaaaacatagttagaaagaatgagtaagacctagtatttgccagcaccacaaagtgactatagtcaaaaataatttagttgtacattttaaaataatgaagagtgtaatttgtttgtaacacaaaggataaatgcttgaggtgatgaataccccatttacctggatgtgattattatgcattgcatgcctgtatcagaatatcttatgtgacccatgaatgtatacacctattatatacttacaaaaattaaaaacaaaaaaatgaaattgcagcaattcagtcacttctttatactccacttctaattctagctctcttgctatttctaccacatctgcagttgcttcctccattgaagttttgtatccttcaaagctatccctgagggttagaattaacttattccaaattcctgttaatgttgatatttctgactttctcccatgaatcatgaatgttcttaatgtcatcttaaatggtaacttttttcagaaggttttcaatttcctttacctaaatccatcagactaatcactgtgtatggcagctacagccttacaaaatgtatttcttacataataacacttgaaagtttaaacaactctttgatccatgggctgcagaaaggatgctatgttagcagacatgaaaacaacattcatcaccatgcacatttccatcagagttcttggttgaccaggtgcaatgtcaatgagcagtaatattttgaaaggattttttttctctacagtaggtttatgtgggcttattcagtaaaccatgttgtacacagatgtgctttcatctagaaatgtgcttcatttcaagagcacaggcagagtacatttggcataattcatattggccctaggagttttggaatggtaaatgagcattgtcttcagtttaaagttaccagcagcattagcccctagcaagacagtcagtgtcttttgaagtttcgaagccaggcattgtcttctcctctttggctatgaaagtcctagatgcatcttcttccaatacaaggctgtttgtctacattgaaaatatgttgtttagtgtagccaccttcttcaatgatcttagctgaatcttctgggtgactttttgcagcttctccacctgcacttgctgcttcaccttgcatttttatgttatggaaacagcttctttctttaaacctcatgaaccaacctctgctagcttccaactttgtttctgcagcttcctcacctctcttatccttcacagaattgaagagctagggccttgctctggattaggctttggcttaagggaatgttgtggctggtttgatcttctatctcgactattaaaactttctccatatcagaaataaagctgttttcctttttgtcatttctatgttgactggagtggcacttttaatttccttcaagaacttttcctttgcattcaaaacttggctgtttggcacaagaggtctggttttttgcctctctcagctttcaacatgccttcttcactaaacttaatcatttctagcttttggttgaaagtgtacatgtgtaactcttcctttcacttgaaaacttagaggccactgtagggttattagttggcctaatttaatattgctgtgtctcagggataggaagggctgaggagtgggagacagatgggggaactgtcagtttgtggaacagtcagaacgcacacacgtttatccattaaatttgctgtcttatatgggtgtggtttgtggaagaattccgatagtaacatcaaagatcactgatcacagatcatcataacaaatacaataatagtgaaaaagtttgaaatttttcatttctttaaaacatttcagagaattaccaaaatgtagcagagacacaaagtgagcacatgctgttggaaaaatggtgccgatagacttgattgagatagagctgccacaaaccttcaatttgtaaaaaaaaaaaaaaaaaaatgcaattatgttcaaagcacaacaaaatgatgtatgcatgtatgccatttccaaaggaatcccttggcagtcacattccccttggccagcaggtggcagtgcttgctcatcgaggtacagaatattgaccctgccttagcatcagggcccagcaggagttttagcttgctgttttacgctgcatgtgttctaattttctcccttttatatttcttattctgtgacttgttgtttctttcccaccacttctgttcccctccaatgctagacccatctctattatgcacctaacagcctcctcaaatatgtgccttgtagaatgtggcctttcaggaatgtaggtgaggcttacgtatcaccccctgaaagtcccaatgagaaataatgcatttaaaacaagccatcttgaaaagcctgaaaaattatgactaaatcacaaaatattaagtcctaaaggggaagggaagacagatactcagctggcctgcccatgttcaccactccaaacccatgacaggccgagatgctcagtgtgaggctctgttaccacactgggacttgccatggcttcagagtccttctgagcacagctactcaagaagcttctcctcctaacaggcaagcatgacacactctgccaaaccaggaagggcaagtttctgtaatagggtacactatatgtgcagttcccaggcattacatcctgcatttagctgcattccaggggccactggctaagtctttccacctttttctcttctccagtatgataacaacaatgcattaataatagcagctactattaatgagcccatgctatatgtgaggcaattcatgattcatatgcattatcacatgtattcttcaaaacaagatgaaaagtagaagttacacaagtggagaccacagactaggttaaaaaattggtcaacggcaaagtcacacagacaataaggggaagaaccaacattgagttgaaaccatctgactttcaaaaccttactcttaacctcccactcttttgaggtactccaagccaccacatgttctcccttcagctgctaaaagtggagcaacgccatcacccccatgtccacccacacccacaatttccctttgccaccccccactcatagctctgcagatcagatttggcagccgatctgctgctctggaaaggctgtggtcctttagttcagggtcccatctccagcattatgggaaagaggccctatagtacccaggtaggcaatcagcccagtggcaaagggtagctgggcttaaggcgagggacctcacaccgccagcagggctgcaggagcctggtggacttgtggcatgtggggaaacccgaagggaggcttagaggtggcatgtcccctgattcagagctggtgtttggcgtctctgagtcatcagtaattctccacaccctgggggagggcaactcctcaaaggacccataaagaaataaattctcatctgagtggctgttgaggtgagggaaggggtcaggtcttctgcagcctgggtgaggtatatgaacaaaccattcttgcaaaaactggcctggtttctctgtgagagcactgtcgagagatgtcacattcctgttgctttcattatgtggtgcattcccaggtctgatgaagaagaaagagaggggcagattgccatgatagttttggttgactgcatcactaatttcattgacctgaaaaatgggtagccatggaaactgtggaaggcttgttctggaagggccctactagcctagtgttgctatatcttttgtaacttatgttccagaagtcttccacctgtgggttacaaactattaatggatcctcatataaatttagtgaatctcaaccaaacatttttaaaaaggaaatatacaagaatcaaatacaaatgagatatcctacagcactcctcatgttgagtcaagtaacctttgggagaatttttgtttccattctacacagttatgagtacaccgagtcacaatataaaatgtgttcttactgtggctgtggtcaaaaatgtttgtaaactggccaggtgtggtggctcatgcctgtaatcccagcactttgggaggccaaggtgggtggatcacttgagctcaggagttcaagaccagcctgggcaacatggtgaaaccccgtctctactaaaaaaaacaaaaaaaaaagagcacaaaaattagctgggcatggtggcatgcgcctgtagtcccagctacgtgggaggctgaggcacaagaatcgcttgaaccctggagacaggttgcagtgaaccgaaatcacgccactgcattccagcctgtgcaacagagtgagaacctgcctcaaaaaaaaaaaaaaaaatgtaaactgctgctaacccaaatctcaactttaccgaaaggaaagttccccttttttatttttccagaatttatagcactaaatgcccataggagaaagcaggagagatctaaaatcaacaccctaacatcacaattaaaagaaccagaggggctgggcatggtgactcacacctgtaatcccagcactttgggaggccaaggccggcagatcacctgaggtcaggagtttgagaccagcctgaccaacatggagaaaccccgtctgtactgaaaatacaaaattagccgggcgtggtggcgcatgcctgtaatcccagctactcaggagactgaggcagaagaattgcttgaacctgtaggcggaggttgcggtgagccaagatcgcgccattgcactccagcctgggcaataagagcaaaactcagtaaaaaaaaaaaaacaaacaagaaaagaaaaaaaagaactagagaaacaagagcaaacaaattcaaaagctagcagaaggcaagaaataactaagatcagaacagaactgaaggagatagaatgaaaaacccttcaaaaaaatcaatgaatccaggagctggttttttgcaaagattaacaaaatagatagaccactagccagactaataaagaagaaaagaaagaagaatcaaatagacacaataaaaaatgataaagaagatatcaccactgaccccacagaaatacaaactaccatcggagaatagtataaacacctctacacaaataagctagaaaatctagaagaaatggataatttcctagacacatacaccctcccaagactaaaccaggaagaagtcaaatccttgaatagaccaataacaagttctggaattgaggcagtaattaatagcctaccaaccaaaaaaggcccaggaccagttggattcacagccaaattctaccagagctacaaagaggagctggtaccatttaattttttgatagagaagtggtaaatcatgaactaggctgaaataaatcaaacttagacatatgcgaggaaggggacaacgctcaggaagattcctacctaccctgaagaattccagagaaactagaggcatgaagaaggggaagagtgaaacataggaatgaaaagagtcaagtctgtcatccaacggatggaagtttcagaaagagagtatagaaatagcacatgagagaaaagtgccagaaattataagatactttatctgagccaaataatacaagtcatcatatggatagagtccacagagtagccatcaccttgaaaataatttcttatgtctagacatattgttacaaaatttcagaacatggaggttcaagtaaatttgcaacagcctccagaagggaaatattaaagcaaaacaaaacaaatcaaaacacaggtaacccataaagtagcaagaatcaaacttgtttcagcaacactggaaactagaagaccatggaccaaggcccatggaccagggaccacacctgagagagaaaaagcatatgccgtctctttatgtacatatgaccatgggaaatttcatagaaactcaaagttctgccggaagtggtattcaacctagaatttttttttttttttttggagatggagtctcaccctattacccaggctggagtgcaatggtgcgatctcagctcactgcaacctctgcctccagggttcgaacaattctcccgcctcagcctccctgagtattgtgcgtatgagattcctatgttcaatgagacttgcttaaatttgccttaggcctgagcaacatgtctcccaaacagaaagaatttactctgcctatagttgggcaagccctttggaaacataaacataatgatttgaggtaaatgctgcccttctccacatgtaaataatacccattgcattgaaagagctttgatttatatttattatacattctgtcttctagaaacacactagttaaataacaataaattcaagcaacatgaaaaaagaaaagattttttaaatcccatgaatatatttcttttgtactattttaagaaaattcattcattccattagaaataataataccaacaataaaaatacggtggtcggggaaggagttccattttcagttctggtagagcagcttatatcacaacaaccctcccactgcaaacagctataaaagctacgtaaaatgcaaagaacatcaagaggcaataaaagaagtcaggacttttgaggcccaggtcctaagagtaataatatacattgagatgggtgtggccttttttgtttttccctgcttagagtcagatttttatggataaataaacaaacactgctggggttttgattaggattaaagaataccattaatgaacttgacctaattgatgtatgtagagcaatgcactgtataattacaatatatagtcttctcaggtgtacttagaaagttaccaatgttaaccatattatgaacaatgaaacaagtttcagaacattttaaaggagattatggtcttcgcagagaatagaattaaattaactatcagtatcaaaatgataaatggaaaaatcatttaataaataaaaattagaattgttctttctgttataaagaaattgaggctgtaattcaaaacctactctcataacaaactccaagtgcatttggctttaccagcgaattcgttcaaatatttaaggaacgcatgaaattacaccaatattatatatgctcttccctaaaataagtaagttttgctacagctggtcagagtgtaaactggtaccataactacttcataaactatttggcatcctatactaaagttaaatcaatgtaatcttatgatctagtagctttacctctatgtactcataagaaatgtgcatatatatttaccaaaatgcattttcaagaacattcataacagtatttttaataaatgtcccaacagaagaaacccaaatgccattaatagaaaaataattgcatgtgtatattcatacaaatgaaatactatgctattatgaagataaattaatcactgcttctcaccacaacatggatggatgaatgaagccagccacaaaatagtacatgcagaatggctcaatttaaataaattttactttatataaaagtcacacatagctaattcatggtgaaagaagccaataacagtgttcacagaggataataactatggagaggcccatataactcagttttctggtaacattttttcttgtattaactctgcaaattgaatgttgtattaatagtttccatcagtcaaaatagtgaggttctcttatttctataaaatactttcagtttcatccatgttgtttcaatgacaggatttcattctttttatggctgaatagtattccattgtgtatatataccacattttcgttttctattcatccattgatggaacttaagttaattcttatcttggctattggctattgtgaatagtgctacagtaaacatggtagtgcagctatctcttcaatactgacttgctttattttggatatatacccagtgatgggattcctggatcatatggtacttctattttttgtttttttgaggaatctccatactgttctctatagtggttgtactactttacattcccaccaacagtgtacaatcattcccctttctctacatccttaccattatctactattttttgtctttttgattaaagccattttatctggggtgaggtgatagctcattgtggttttgatttgcatttttctaatgattagtgatggtgagcatttttcatatacctgtttaccacttgtatgtcttcttttgagaaatgtctattcagaactgtattagtccattccagcattgctataaagaaatacctgaggctgagtaatttataaagaaaagagatttaattggctcatggttctgcaggctgtacaggaagcatgatgctgacatctgcttgacttctgggcatgcctcaggaaatttacaatcatggcagaaggtgaagggggagcagacacatcacatggccagagcaggagcaaaagagggacgggggaggttccatacatttttaaatgcccagatctcgtgagaactcactcactatcaccaggacagtacaaaggggatggtactaaaccattcatgagaaatccatccccatgatctaatcatctcccaccagaccccacctccaacattggagattacattttgacatgagatttgggctgggataacatccaaactctatcaagatctcttgcccattttaaaatcagattatttgggcatttttcttgatgtgaatactttattaaattaatgaatgcaaaccacctatcacagaacctactagtaggtgatgttcgaggaatattggttcctctttccatacctatgtggtcatcttgaaattgtgtgacctccttcacataagaactgggcaagagaatttggataatttagtgcagtctacccaaaaattcttaacaggaactccaagcacgtatctgcagggcagcagcagcaacagactagccattctttccagggcttcttccatagctaaaactcaaagaaacatttatgcccatgtttccaaggaggaacatatggccagacatcagccatgtgttcctccatgttctgaaatatagaaaaagataaacttcccacatgatttttttttttattttgcctcgttttgtcccttagacttgacagttgtacattttatctgtggtaaaggggatgcattatttacttcttcactcagtgaatactttttcagagatttttctctttcatatgaagagcacccatcccttattatgtgttaatcaaacttaatttatattctctctcagcattttttgtgtgtttctaatatatattaaaatgtgacaagaaggtgtttgaaaataaaattctcattccattgtggtatatatacacaatggaatactattcagccataaaaagaatgaaatcctgtcattgaaacaacagggatttaactgcaagtattttatagaaataagagagcctcactattttgttacgggctgaattgtgtccccttcaaaatttatatattgaagtcttagcccctaggacctctgaatgtgacttaatttggtgatagaatctataaagaggcatttaaattaaaaggaagtcagaaggtgagctctaaactaatatgaccttataagaggaggaagttggggcacaggcatgtacacacagaggaaagaccatacagaggaaagaccatattaagataaaggaagaggatgaccatctacaagccaagcaaaggggccccagaaggaaaccaaacatgctgaaaccttgatcttgaatttgtagcttctaaaactgtgagaaaataaatttctgttgtttaaaacatccaggctgaggtactttgttatggaagccctgtcaaactaatgcaacaacatttcctcccattagatttcttaattcgtgtatagctggcctgataatgtcttatcagctaccccaactcaattgctgcaaatacatttttaaaagttctggtggttgtagttgattgcacacttctgtatgagccaataatgtgaggcaagtctttaaaagggtagcacaatcagtctgaggttacaccatagatatggttaaccatagtgtggtctccataacataggaagtcaagatcccccttcactcttgaccagtcagattgcacctagaacatttttctcaattctgcataccacatttaaagaggaagacaaaacccatgcgttgtgcagctaccacatgtcgagcatcagactatgtgcactgtgtacacttagtcctcccaccaacccaatgaagatggtattaatacccacctcccattgtacagatgaggagactggggctaaatgaggtcaaataggttgctcaaggtcttatagcttgttagtgcagtggtcaggatttgaacaaattctatgtaagtttatcatgaaaccactttgcaagaaaagaagggcaaacagggtggggaggtatttggctactgagccacctgggaagtttggcaaaggttgagtgtggttcatctaaataaaaggaaccaagaaactctttaaatgtatttgagggactcttgtctcgaaccaagaaactcttgaaatatatttgagggaacaggatcaagcaaggacagctcttccaattctcccatctcttctacattctcttaattcatctgggcaacaacctggtcatccccatcccctacaaaaccttcccaccggacatctgtacttctcctcccatggttaatagcctcccctacaccctcaactattctctgaacatctccacaacttcatggccttctttcctccagaagaccccatggcctacagacagctaagctacagcagttggctctccaactactctacatgccatgctatgagagtggactaggctatgagagttgtttttttcctagctcctcattgacatttctatactttcaatccttccactgcatgcagatccctgtgccccactgaggtgtgggcctctcggctctaattccctctgcccctcctttgtaatgggggtggtccatgtactgctgtgtcctcacatgagttgctttattaagaactcgggcactgcattgcagcctgcctctcctcgctaacatttgccatctttctgggtgacttcagtggatccaataccctgcctcagtcatccttgacttcctcattcagagatcttcacctccatggactcccatagccacactctgaaccctgtcatctctcagaagtgcactgcttctgaaatctgcatctcatacacccatcctctgactaccacctcctgttccctggcttcctaattcactcacacccaagatgactgtccttcaacctcatcaaactttgagttctttttgactctttgactttgctcccatcttgtgttcacttcttggcattctactcatcttagactcagttcacttctgccattttcttgcacaaatcctgaattctctcatgcagtgcccttctgtaccacctgcaggcaaaaaccaaccctgatcaactcaattgtcctctatacttgctcgtgggtgggtaagaaaagctagaaaagctacccacagactcctaccattactgatttatgagctccaggctcaactgggcccttatctgggcctggaaatcattttgcatttctacagtcaagtctcctttctgaacaaaagatacaacattgaaaactgtcttctgtttcctgaaatgtctactcactacctcactttcaacagataaccttgccctctctttcacaaaggaaatggaaaccacaaagaggaagtccctcaccctgctgtccccagccctacaaatcctcctgcatctgcactctgctccttccctctttttacagagaggaggcccctcctgtctaaagcaaattccatttccttcctgccttgggctcagaaatctcaccccatccaaaatcttccatggttagcctgtccctttgttgcgactctttctcaatatttacaagctcctatattttttaaaataataaaactaggtcctcctggtgttcacatgttttcccaattgtagccaagtcctctcattcttatcacagcctcagacattttgaggtgtctcactacctcacctcaacccacaacatctggcttccctcattgttttccagtaggccccttactggggtcactgtcaacttcttattgttaaaccaagggtcacttatcagcccatttttatttacactcttggcatcaaatgtgtagtacctgagactccagtagttgccaagccccatagttgcagatttgcattctcttccctgcctgccttttctcttctctatttcagacccctcttcttctgctgtccttcaaaccaagatctccaagcagcgttcttctttggggcatcctcctttctaactgctgcactctcttgtgactttgtttaccttatccttatccatgacacccatacctatgtctccaggccagatggccagatgtcgttattggactccacctttatgcatccaactaaccagccaatatgtcccacttagagatggtccctgcccaactcatctaaactcaatcctgtgaaaagctgtattcattctctttctccacataatggttattcttgctgtgcattttttccaggggatgacattatcattaactcagattcccaagccagaaacctgaggccagccttggccccttcctgcctctcagccccattttagcttattattcagtcaacaattcatggaaatattacttttgagtctttccatttctctttcttgccattctctgtattctcatctaattcacatcactaatatctctccatgtggtggtgtaatgtgtatttgctatattctttcagaatattcaattatgctgtaaaagacaagaaaataaatgggatgaatgaaattcatacaatgtgctaggcaaagatgactgttgtagtcaggtctgactgccataacaaaataccatggactagattgcttcaaaacagaaatttatttctcacagctctgggagctagacatcaagattagggtgccagcatgggcaggttctgtgagtgccctcttctgggcttgctattgactgccttattgctgtgtcctcccatgacctttcctcagtttgtgtgtgctcaatgtgaagaaaggatttctctcacttttccttttcttatacaaccaccaattatatcatattagagctcaaaccttatgaactaatttaatcttaattacttcctaaaagccctatctccaaatacagtcatattagacatcaggacttcaacatatgaattttggaagggcataattcagcccatagcaataaataacttattaaccttgaaggcatgtaagataagtgaagtaagtagaacatatatgtgtgaacatataaaatgatggaaagatcaaggaaacactaatacttattgatatatgtgataaatatacatgaggtacagggggcacaccatttttacttcaggaatgtgaagcactctgtatttatgaagtcttaatttggccacccattggtgacacccatcttggtcccatgtgtcctatgcctaagaaatacaattaagcttttagctgttcagcagccttattagcaagccacaactgtagccaggtgtacttgtcttagcatctctcagaggacagtgcatgtcactgctcccaagccccttccctctgtggaccccatactcaaacctcaactctggtgtttataaccataccattagcaaggaagactgactgatgcaacagagagaaaggatgaatgcccaatccataccccaggattcaagtaaagtagttctgcttttttgaacactgtcctacatgtgtgaacctatctcatctctttccctttgattattgctgtgtgcattaaaatttacttggtaaatggtttgtgacctctgggatagtttgcctggtgatttacttggaggctaccattgcatcaaggtaatttcccacgacagatggattgtattaatgatctcaatctttgacccttccctaaatgtacaccctttgctatgtgactttacagtttcttcaatcaaaagacaaaatgtgttttcctgtcctttgaaatttaactcagccatgtggtgtgtcttgcccagtggagtgttagcagacatgatactagcagaggcttgatagaattcttgtctgcttgggcttgcccacctgaacctcttccatatctatgcgaaggatgtgcccaagcttgctcacttttcccaggaggaaaataaaacacacagagtgtgaagccaatcttagccaaacccagtctatatgactctcagctttctgtagatgcccagacaaaccaagtttagattagccatctatcatctgatctgtatgctcatgagaaatcgtctttaaatgttgttttaagccactgagtttggggtactttcttatacagtaatactcacttagacaaattctgtagcctcttaacttgttttcctgctacattactcccctccaatctatttcttactgaagtcattgtgctcttctacaacacaagtctgattaccttatttcctttcttaaaccatttgatgaagcttatatttatctttagattaaattacaaacttctgcataagcttgtccctgtttattcaactagccagcctcatttctccacctataaatttcaactatggtgaactatttatatatccttaactgagccattctctctcttacttctaggcctttaaacatatcattttctctataggggatatgtattagtttcctagggctgctataataaagtatcaccaactgggtagtagctttaaacaacagaaatttattgtctcatatttctagagtctagaggtctgaaatcaagatgtcagcaagatctcactccctctgaaacaacactcatccttgcatctttctagcttcaagcggttgctagtaatccttggcattctttgccttctagctgcagcacttcaatctctgcctctatcatcacatgatcttcttccctcatgtcttcacatccgcttcttataaggacaccagtcatgttggattaagggtccattttactccagtatgaccttatcttaactaaatatatctgcaacaatcttacttccaaataaggtcacattccaaggtactggtatttaggacatcaacatatattggggggacacaattcaatccatagcagaatactcttccaaatggccttttctggccattaatcctactcattcatcagatctcatccttgctatcagttttccttggaaatcattccttgtctccaagatctagttaagtgccacttaacttatgtatacataagatgtcatgagttgctgaatatggaacaattacattaaaaactttgatttagtggcctccaaattaatgggatcttattttattatgatcttattttattatgaatgtaatggtggtacaccgaggtttgatatgggctttgttttgtactagatatatatctctaaggcatattataaagccatattggaccagaaattcaaatactttcatgacttcctctcaattcctcattgctgtttccctttgtatatcagcattatgtgtctttctagatgcagacaagctttctttgctctttgtcacatagaaacttatggccattctgttgtcccccaggtgagtttaggtattactcacttgaggtattacagtcactcacaaggacagagatagggtatccaaaaattccaggtaaaataatctggtttgcccagcttagggtagtgttaaccagttaaccaaccagctatggcctgggataaggttatgcagttcaaacatgatttctgtgggtatgtgggtgtcagtgttctctgaaaaatgggatttattaactggtggttggaaccataccccaaatgtagtggtgttcatcatagtgtaattatgtaacagattggcttcgcctacttaatagaaatagtactaatgagtcagaggacataggttccattcccaaattagtaagggagattttcttggttcattgccaaatagcacattgagctatggataattgtctcaataacactttggtaagaatgtttccccattcctttcctggtctagctttcataaactatagagaagaaatgaggaatggggacttcacaaactccaagaaaataaagactaaaatttatttcctgatagaccttgacttcacggagggcaggaaatgcctcttatttatctttgtcttttttgtccctccccagaaactaaaacacttcatgggccatataaatcttctagtagaccgaattaaaatggactggaccaggccatttttaacttcagacacaggatgatttgaatactattgaaagcaatgtgtaaacaagatgtcatgggttgctaaatatggaaccaatacaatataaacttctcatgttacaccactaactacactgtgtattaattgcctgtgaacacttctgcaccatccactaggctatgagttccatgaagaatgagaaaaccatgtttgtcatggttaccactgtttccataatacctagaatggtagattgattgtagtaataaaatcaagtaatggcttttctctagccacactttacggctgcagctttgtgataccatctcactctgagtcattggccaagtgacttgctttggccaatcaaatgttagcaaatgtgatgcaagaagaggtttgaaaagctcacacctgtaatccccgcacttggggagactaatgtgggcagatcacatgaggccaggagtttgggaccagcctggccaacatactgaaactctgtttctactaaaaatataaaaattaggcaggtgtggtggctcacatctgtaatcccagctactcaggaggctgaggcatgagtatcgcttgagcctgggaggcagaggttgtagtgagccaaaatcttgccactatactccagcctgggcaacacagcgagactctgtctcaaaaaaaaaaagaaaaagaaaaagaaagaaaagaaaagaaaagctcatatatatttcctcttgctcttttgtaagatttggctcactcactgttgcatctttaactcatcatgagagtaagtctgggttagctttctggaaggataagaggaaccaatgaagaaaaactgaagccatcctaaaccagctaagaaccagatgcctttcaaacatatgaatgagttcagccaagatcaacagagccacctatccaacccaaagatgagtgcagatatataagtgaccctggtgaagaccaagagaactacctagacaactcatggacccaagaacaataatgcatgattaatattttaagccacgatgatctgcagtagtttctatgcaacatttttgtagcaatgaatgataaatatatctaaccctcaagatttgttccaggtgctcttttttctcaagcctctttaaataagttctctaacccaaaacagtagatcaattattttctctgcttgttttcatggagttctctcacctcacttattttaggctacatttatgttcatcatttcctataacttatcagttgatgggccttgaaactgtgactctctaatttcctacttgtctctcttttctcttttccaaattgataaatatatattagaaatacagtggccattttttctttttcttttcacacatacttttagcaagtttatttttcctcttaactgctaggccttatgtcactcttatccactcagtgttatgccaaagccattgcatacttggtcatgaaagctaattgctaaactttcagaaattttgtaaactggatattaaatataaccatctttgaaatctgccatggtggaagtatttacaccacagaaatgggcaaattctacaaatcagggctgcctctctaaatccagagatgcagttattaaacatgtactagtgtatgtaccattgtctataccatttatattttattgatgaaacccactcacctttcaacctctctcagaggggcagatgtactgcctgagggattagaaagctgagaggagataggtaaaggtagtagaatctctggaaacagaatataaaaatttgatttcctatgcatctgtgtctcatggatgcacaaatttctgcagcattctttctacagactgtcttaactggaaaaggcattatgtgtgtgggtgtgaccaaaactctagcatttactttcctcactggtgctgtgatagaaattacccaatccttagctgcccatcctataaagctccttcttgtgcttgaagaatccaccactgtgacagaagacgaaaagctgaaatatttattctctttgattcttggcagatggagcaaaagcagaaacataatgagatgcttccaggactttatatattgatgagaagtaggagagtttagaatcccattctactgccagtgctggtggtagatgccactgatccagatgttttcctttggcatcaccttggcttccctttattcttgccttgtttccccttctgtttctccaaccttcctgtcaatctatcaagacattgtgtagctttttgataagttatgttttgacagagttaatcaaaagttggcttctgttgtttgcaactaaatgccctgcttaaaacaagcaacatgctgagaaatccatgaaggtgccaccagtggatatgggagacatgaagtggctgttgatgccaccacctggatgtggtgcctggtttatgcagctagacttccactaatggattaactcagttgaaaggagtgtagctgactttcacattcagttatgctttttctataatattaaagctcttcatttaagtaatttaaataaaagtaaagtatgctgcattgaagaggatatataattttgagaaagatgtagtcactaacactgagagaaataaggcatatatttttttcattaatctttcattgttctccctcagagcttgacctaacagtttccacccatgacttttccttgagtactataaaattaagttaaattttcttggctattccttctttgactgattgtctttggctcctaaatcctttagcaactttgcaccaaaagcactagcaccatttatctcttgatttagaaacaaagagatacaattatgactatattttctcaatatctgagctaatattagaggaatagctagatctgcctcttcatgacatttagaagaaagtaagactctggatatcactctcagttttgtcctttcttttattgtgacaaaaacaaaagaaaatgtacttgatggcaaggtctttatgaaaatctcatgaaaatcttttggttttctattcaaagtgagttttgttacatagttaagttcattaatttcgctttgaattttaaagattgctctttgaatataaattaggttttctacaagtatataaaatattttattgtttccaagcaaatatataaaacaaggcacagtcagaaaaataaagatttgattaaaccaattttcttagatacctgctagtatattatacatacatttcctacatataacttttaaagtggtacctaaaatgaagctaattcacaaattaaaaaaatttaaacagtaaagaaataaaacagagaaattcaataaagacaatacttctgcctttaccctcacttcctgctttctctgagcctagaaatcagccagaggtagaagtttaagttcttcttagctattttccaagtatgtatcttgcccaggacatgtgtgtgggctttagttttcctagtctacatggaagcttttcaaagcccttattcacccaaggaatctcacaccaaagattttcctgccagagttttattgtgtcctttgtttgttccaaatgtttttatttatttatttattgccctagatgatagtggcttgcttttcaaagttttgaggaaggaacttcacataaccacttctctaccctgagaaagctccaaattaggtaaaacaaaattaagcaccttgtgtcagttcttcagggaacccccaaacagatcaaaacagacaaacactattctgctctgctgaaacactttctgctctgttgaaacaatatctgctcttctcccttcagaaccaggtgcccacaatcagaatgaagaattctgtctgaagatcactgtcccactgagaaggagtggggtggaacaaaagtaaaatgccacaaagctatcatgttgtgctttctcctggttgagcattcacttagttgctgtaaacctttcattatcttccagggtcctgagaagtttcatcctgattgcttttttcacagatttttcaatggttctggggatatacaggcccctagatttccttactccacctgtatgactattaggcagctcaggctgccataacagagtaccagagacttggtggcttaaacaacaaaaaattaggattattggattaggactccacctttatgacctcatttaaacttaattacctccttaaagatcctgtctccaattacagtgacacagaggattaggtcttcaacaaatgggtgtgaggagaaagggacaaattacattgtcttttttgctgacatcatcttgacttcattattattattattttttaataaaacgaaaacctttcccaacaatgctttaccctcctttggaagattattgaaggctactttcaaggaagtttggaagagctattatttgtttttcatcctttatattgaggacaacagaaaagaagggagatgataaaacatttggaatagtcaagacaatgcctgctatgctggtatttaacaaactaaactattctggggagatgtgaagtggagacagccagagggaatctcattttgactctagggttgcattgctcatgatgcctctttgatttcagctatttcatcaacatagtaattgtatatattcacctgagacccaagcattgctcataattgggacatattgctagctgtttcatgagagttttgggatctatagtcaaatgtgtatcataaatccatggacccttcaccaatttgatgggcatgtttcttttctttctttttcttttcttcttttttcttttttcttttgagacagggtctctgtcacccagtctggagtgcagtggcatgatcactgctcactgcagcctcaaactcttgggctcaagcagtcctcccacgtcagcctcctgagtagctgggattacaggcacacactaccatacacagctaatttttttattttttattatttatttatttatttattttgaagagacggggtctcactgtgttacccagactgatctcgaactcctggactcaagcaatcccccagcctcagcgtgccgaagtgctgggattacaggcatgagccaccacatctggccaggcatgtttcatttttaaatccaatcagcacttttaaaactgaaccacacttacaggactgatatttatccaattatatatagatatagatatttaaatttcaaaagcaaatagaaaattttaaattactccatagtcatcaattttttaaaaaaattatgatttcacttccaccaaaatgtttgcctgtgttcaaaatatttatttaatccatttaggccaggaaagtttagcaaggaaaatgggtgtagtctcagaattatatacaaatatgatttgagtctgaataccttcatttccttgaactgagggcagtattcacactttatgcttatagtttcaagttcagagtgtgcagatgtctttgcacatccatgagaaagtaaaatcttgtgattcatttgcagtcttgctgattgactttcttaggattctttaattactgagatactcagtctcagaaagcaattctgtaaatctcccaaatggccacaaatgaataatctcatattaaagtataataaatattcattatctgctttacttttttatgtccactataaaacaggctgatgaataacccctggtttaccaataggaagttgacagcaacctcagtaaggtcttactggagagaaatgaggggaagcagatgttgtgggttgaggtgagggagtgagatgcctcaaaatggctgaggctgtgatagggaagaaagagcttggctgggattaggaagacatgtgcacaccacaaggatctggtttcattttgtttttaaatagaagcctgtaaatgttgttgataggaagctaatctacttcaatttaggactagcttctgccttatcccacaagatgaccattaattcaaggttgatgttgtgttgtgcttgttaattagctttatgaagatataaacaacagaaagggactataaaacaggaaaaggaaaaccagcaataattatcgtgtatcccttttttccatgatcatcatcatgaacaggaaagccccttatcggccatatcatttcttgggacagatattctgttttattccgtgacctattcctaatctctgtgagaaccacttctatccaccatgacattctcttccacaaactccagagcaagcctcacatcaggtaacactgtaagtttctccacccaagaacatcaccctttcattttactgtactgagcagtttaactcttctctgactcaacctctaacccctagaccaggcagtgcctttcaattcccaaaaagtccatcaaagtgtctgccctactagaagagcagcctctcctcaaaactaattccccaattcccagagaaatgtgcacacactgaagatagcttctgaggtgttagattttacaaaccattttcttttaaaataatttcatgcagaagataaaggtattacaaagaaatccaaggtactcctgatccagattcatcaactattaacattttgtcacatttacgttgtcattctctctctctccatatgattatttttttctattttcttttttctttttctttctttctttttttttttctttttttttttttcgagacagagttttgatcttgccacccaggatggagtgcaatggcgcgatctcggctcactgaaactgctgcctcctgggttcaagcaattctcttgcctcagcctcccaagtagctgggattacaggataaggatcctgtaattacattgggcccacccagataatccatgaaaaactttctttctcaatagccttaatttaattacacctgcaaagtccctttaaccgtataaggtaacatatccacaggttctagagattagtacctagacatctttggttgggggtaatatttatccaactacaaatggatatgataattttacatacctcataaggtggttgtgaaaaataaatgagacaaagcacataagacatgtggtgtgtataaaatgctttgtaaatgtcagctgttgttaataagaccaagttgtttgtaaaaaaagatttttcaaggaaataagccaatataatacaggatgcatactgaaaagttttagttcaaatcaataactagagatttcctcatttttcctttattctgatgaattaatgtatacaagtcatatttaacataaaggggtaaaatgtaaatcttcatcgccagacattttcattttctattaagtgaaatgccagtaaaagccacattcttaatgcctttaattgcctagatcagtacactaacccttcttccccgaatacctcttcttctactttgttattttctctcccaaacaagagatagaacatttggatcccattccagcaaacttcttcaacttttattaactcttgagattctggtgatgaaataaaagtgagtttctttataccatgatttactgagaacccttcttgatataagcagtagaaatacaactggaactgttttccttaagcagaaagtggcagtggtgggaatttatggcttctgtagccaggttaaatacagtgatgtggcaaccaggtccaagatcttgcccaagatcactcaaggtcatcccagcttcagatctcctcgtgggattgctgaggccttattgtgaccacatgataactcaactgctccttctgcccacttctgctttcttatttttcattgccttttacagctatttacctctaagaacactccctaatgaaactcctgcacactaaactccatctcagaatctgcttcccaggaaacccaatctaaaagaataattgagaggtccaagtatctcaggcagatcagactcaataattcaaacactgtaatcacatctgtctccagacttctctatccttccctaaatactgattatgattttgtttgtgttgacataatttttatgtagctatttagcacaaggtggtccaaatggcctatggcagcatcaggcatacatcattcacaaagagagaaaagcttgactttctcttctccaaagttcctaaaactccaccccaccatgcaaaaaactaattggtcttccttgggttaaatgcccacccctgggacaaacactgagtccagaggaatgaagtcattgcagtagccatccttaggcaaggaatgtggggctacacaaatcatagaaggatatagagtgggagcatgatggttctggaaagaataggatacatggcagagataaagggaacagaaatccatttttcattagcacaaggaataaaactcattaagaaccttggcatagtaacacatctctctttcatcagcaatttcatacatgcaccttgacgtaattaggaacataattttgtggttgaaatttatttttattattgtgacagtctacaactactgtattattccatttcagaaattttttgactatgagttttaacctactatggaaagcataatattgaggtttataataaaaaattatatttgatttgaagtaaaaaggtccagagcacattctctcactaactggctataatctcaagaaagcaaccaagcttttctgaaacttagtttcctaagtaaaatgtggaccactggggtggagccaagatggccgaataggaacagctccagtctacagctcccagcgtgagcgatgcagaagacggatgatttctgcatttccaaccaaggtaccgggttcatctcactggggagtgtcggaaagtgggtgcaggacagtgggtgcagtgcaccgagcgtgagccgaagcagagcgaggcatcgcctcacccaggaagcacaaggggtcagggaattccctttcctagttaaagaaaggggtgacagacggcacctggaaaatcgggtcactcccgccctaatactgcgcttttccaacggtcttagcaaatggcacacaaggagattatatcccgcacctggctcagagggtcctatgcccacagagcctggttcattgctagcacagcactctgagatcaaactgcaaggcggcagtgaggctgggggaggggcgcacgccattgcccaggcttgagtaggtaaacaaagtggccaggaagcttgaactgggtggagcccacctcagctcaaggaggcctgcctgcctctgtagactccaccactgggggcagggcatggccaaacaaaaggcagcagtatcctctgcagacttaaatgtccctgtctgacagctttgaaggagtagtggttctcccagcatggaatttgagatctgagaatgggcagactgcctcctcaagttggtccctgtcccacaagtagcctaactgggaggcaccccccagcaggggcagactgacacctcacacggccggctactcctctgggacaaaacttccagaggaacaaacaggcagcaacatttgctgctcaccaatatccattgttctgcagcctccgctgctggtacccaggcaaacagggtctggaggggacctccaacaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctccccctccaaagggatgcagctcctcaccagcaatggaacaaagctggatggagaatgactttgacgagttgagagaagaaggcttcagacgatcaaactactccaagctaaaggaggacgttcgaacccatggcaaagaagttaaaaaccttgaaaaaaaattagacgaatggctaactagaataaccaatgcagagaagtccttaaaggacctgatggagctgaaaaccaaggctcgagaactaagtgaagaatgcagaagcctcaggagccgatgcgatcaactggaagaaagggtatcagtgatggaagatgaagtgaatgaaatgaagcgagaagggaagtttagagaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatatcatccaggagaacttccccaatgtagcaaggcaggccaacattcagattcaggaaatacagagaaccccacaaagatactcctcgagaagagcaactccaagatacataactgtcagattcaccaaagttgaaatgaaggaaaaaacgttaagggtagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagaaactttgtcaccaccgggcctgccctaaaagagctcctgaaggaagcactaaacatggaaaggaacaaatggtaccagccactgcaaaaacatgccaaattgtaaagaccatcaaggctaggaagaaaccgcatcaactaacaaacaaaataaccagctaacatcataatgacaggatcaaattcacacataacaatattaaccttaaatgtaaatgggctaaatgctccaattcaaagccacagactggcaaattagataaagagtcaagacccatcagtgtgctgtattcagggaacccatctcacttgcggatacacacataggctcaaaataaaggtatggaggaagatctaccaagcaaatggaaaacagaaaagggcaggggttgcaatcctagtctctgataaaacagactttaaacctacaaagatcaaaagagacaaagaagggcattacatgatagtaaagggatcaattcaacaagaagagctaactatcctaaatgtatatgcatccaatacaggagcacccagattcataaagcaagtccttagagacctagaaagacacttagactcccacacaataataatgggagactttaacaccccactgtcaacattagacagatcaacgagacagaaagttaacaaggatatccaggaattgaactcagctctgcaccaagcagacctaatagacatctacagaactctccaccccaaatcaacagaatagacattcttttcagcaccacaccacacctatgccaaaattgaccacatagttggaagtaaagcactcctcagcaaatgtaaaagaacagaaattataacaaactgtctctcagaccacagtgcaatcaaactagaactcaggattaagaaactcactgaaaaccactcaaccacatggaaactgaacaacctgctcctgaatgactactgggtacataacgaaatgaaggcagaaataaagatgttctttgaaaccaaagagaacaaagacacaacataccagaatctcttggacacattcaaagcagtgtgtagagggaaatttatagcactaaatgcccacaggagaaagcaggaaagatctaaaattgacaccctaacatcacaattaaaagaactagagaagcaagagcaaacacattcaaaagctagcagaaggcaagaaataactaagatcagagcagaactgaaggaaatagagacacaaaaaaacacttcaaaaaatcaatgaatccaggagctagttttttgaaaagatcaacaaaattgatagactgctagcaagactaataaagaagaaaagagagaagaatcaaatagatgcaataaaaaatgataaaggggatattatcaccgatcccacagaaatacaaactaccatcagagaatactataaacacctctatgcaaataaactagaaaatctagaggaaatggataaattcttcgacacatacaccctcccaagactaaaccaggaagaagttgaatctctgaatagaccaataacaggctctgaaattgaggcaataattaatagcttaccaaccaaaaaaagtccaggaccagatagattcacagtcaaattctaccagaggtacaaggaggagctggtaccattccttctgaaactattccaattaatagaaaaagagggaatcctccctaactcattttatgaggccagcatcatcctgacaccaaagcctggcagagacacaaccaaaaaagagaattttagaccaatatccctgatgaacattgatgcaaaaatcctcaataaaatactgacaaaccgaatccagcagcacatcaaaaagcttatccaccatgatcaagtgggcttcatccctgggatgcaaggctggttcaacatatacaaatcaataaatgtaatccagcatataaacagaaccaacgacaaaaaccatatgattatctcaacagatgcagaaaaggcctttgacaaaattcaacaacccttcatgctaaaaactctcaataaattaggtattgatgagatttatctcaaaataataagagctatctatgacaaacccacagccaatatcatactgaatgggcaaaaactggaagcattccctttgaaaacaggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcttctcagcccgaaatctccttaagctgataagcaacttcagcaaagtctcaggatacaaaatcaatgtacaaaaatcacaaacattcttatacaccaataaaagacaaacagagagccaaatcatgagtgaactcccattcacagttgcttcaaagagaataaaatacctaggaatctaacttacaagggatgtgaaggacttcttcaaggagaactacaaaccatggctcaatgaaataaaagaggatacaaacaaatggaagaacattcaattctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctgcctgatttcatactatactacaagggtacaataaccaaaacagcatggtactggtaccaaaacagagatatagaccaatggcacagaacagagccctcagaaataatactgcatatctacaaccatctgatctttgacaaacctgacaaaaacaagaaatggggaaacaattccctatttaataaatggtgctgggaaaactggctagcaatatgtagaaagctgaaactggatcccttccttacaccttatacaaaaattaattcaagatggattaaagacttaaatgttagacctaaaaccataaaaaccctagaagaaaacccaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacagagggctaatatccagaatctacaaagaactcaaacaaatttacaagaaaaaaagcaaacaaccccatcaacaagtgggcaaaggatatgaacagatacttctcgaaagaagacatttatgcagccaaaagacacatgaaaaaatgcccatcatcactgggcatcagagaaaatcaaatcaaaatgacaatgagataccatctcacaccagttagaatggtgatcattaaaaagtcaggaaacaacgggtgctggagaggatgtggagaaataggaacacttttacactgttggtgggactggaaactagttcaaccattgtggaagtcagtgtggcgattcctcagggatctagaactagaaatactatttgacccagcaatcccattactggatatataaccagaggtttataaatcatgctgctataaagacacatgcacacgtatgtttattgcggcactattcacaatagcaaagacttggaaccaacccaaatgtccagcaatgatagactggattaagaaaatgtggcacatatacaccatggaatactatgcagctataaaaaaggatgagttcgtgtcctttgtagggacgtggatgaagctggaaaccatcattctcagcaaactatcgcaaggacaaaaaaccaaacaccgcatgttctcactcataggtgggaattgaacaatgagaacacatggacacaggaaggggaacatcacactctggggactgttgtggggtggggggagtggggagggatagcattaggagatatacctaatgtcaaatgacgagttaatgggtgcagcacaccaacatggcacatgtatacatatgtaactaacctgcacgttgtgcacatgtaccctaaaacttaaagtataataaaaaaaaatgtggaccactgggcaatcactgggcagtcataaagataaaataacatatatacatgaaagtgttacgcataatgtaaaaagcttatagaaaaaataatcatttctcaggtatgaagctacattttaataacctgaaaatattttaagtaatacatttattatgcatatattttcaaagacaagaatgatgttattgattatggtaatatgaaggttacctcagattgttaccactttcaacctgctcacaatgtaaattctgttatcaataactaataatagaaaagaacatattattatatattcctgttaaacttttcaaatatagtacacgtaactctgtgaacaaatcttccctctagggcgttccctagaaagtcctcgatttagctagcagtgtttgcaagtttgcattttctctaacaattcttaatcaatcaccatcatcatcatggtcatatcaattgctaaacatgtcctgtgactatgtgatagtccaggcatcaatctaaaatctaaaaagatttgtgctttacaatccacagtgaaagaataaacaaggcaatgctttaaatagagtttttttttaaattaatcttttctttatatcaacttggatataattaggcaaaaattgggaaaatatgtgtcatatctaatatcagtttctcacagtgccaaattaattaactagaataatggtgattaaactctatagactacttgattattgcagaggaatataatttttaatttaagctttcaagaataaatcttagactgcaaaatcagggaattttctggatttgggtctacttctcttctctcatttttttctcaaccagagatgtttgggatttcaatcacaagtgtgaggatattggacattactgcataatgggtatggtgagtacttccttatgttcaccacagtctagtttgctactaacagcttaggagagaatgaaagccaatgagggtgggagaagataaactgttagctaatgcatacaggttcagttttcttcatctccatgtctagtcaatgcctttcaactaatacctgttactctttcatcaaactttctgcctgcctttctaagagcagtgcacattacattttacttagccagtgttctcaaaagggaagttagtaactttctgtaaaagaaagactttactcttcattgcaactgatctctctctctcccactgtaaaactgattgaggtgcttaaggttctcaagaaattgctactcatagccctgtgattacttttataaaggcgggggggaggggaaatcagtagaatggaatggttgattactcagggaaaagattctttcttttttgaattttcttctcaaattatggagggaaggaaagggagtgggaaaatgttcaagaaataagtttatgtgaaactgggaatgttatttcctggtatatgcagattaatgatccctttgtcattgcctccccagcagagcacaggcttcaggaggcaggtggaaaagtatgagaaaggcttgaaaatttaagtgggataaaggaagatgatccaataggcagagaaagagaacagtggggataagtacagaggaaaagactgatgagttccaagagcttatggtgaagcagtcatctttgtagaggagtttgagagtggcagagatgaggagagaaagtggatttttaaatatgttttatttttctttgggtataaaggcctcacttctttgaatacatgaaaaaaataagtacagatatgagtaacttttttgtttcagtcaaaaaacagaaaccactgtatttcaacagggggaatttcataccaggaaatttgttacatggattatggaaaagtagagaatcccaacatggggtgcagaggcaacataatataaagatgaacaactacaggaagtggttaccaccctaggggttagagggaaactaggaggtggtggtgtaacttgagttcagaagccagggccacctggcagaatcttgagctacagtggtgatggctaggactagctcatgccacagggggagaggctgactggtgaaagttggagcctcagtgcagatgcagccccttcatggatgccacttaaagcagaaagctcagggaagaaacactatggcttatctcctgctatccattctccaattcagctaaacatactagaagccagagggccaaggagcctggcaatacaattttctctgaaacacagtagagcaaggaaagtggggaatagacctgagagcaagaggcaaataattggcacatgttttaattgtctaagtgtgtttctttgaattcatctctgtgtggaacagaaccacgagactaacttctctttatgtggtttacacatggtctaagagccatagcattctaaaaagtacctttccttgaatattaagaagtgaaaaacactactactttgctaattatcgtaattacagaagcttcccaagtagttcatggacaacaatcaaaagagtacttatgtcttttttttccttcttttgttccctttcactcctcccatttcttttttttttacctccatattagctataactgctgtacaactacccttgtgcaattagtcaatattgatctcataatggggttactatcctaccttcctgtctctttcatgtcttgaagagtgggtaccaacaagggaaatgatgctacatttagcttttggcatctaccatatctgacatatctttgtgctgaccctgtttactcacttagcatataggatgtcatgtttgcctggaaacatgattgccatctaaacattttggtatatttcttgtattttgtcatgttttcctatagttgtatgtggagtgatttaatgtagggtttttagtgtaggcatagtaaggcttttttctagtatcttggtcaaaagtataaccaaatttcttgggttttaaatcccaactctactatttgctagttatgtgaacttggccaagtaactgaactgctctggaactcagtttccttatctgtaaatataatcataataatagaatctgctttacagtggttgagttgtgaggatcaaatgaattgatgtgtgtgtgtttgcatgtgtgtctatatgtgtaatacacacatatatgcagtcatatcacttaactatgggggatttgttctgagaaatgtatccttaggtgattttgttgttgtgtgaaaatcatagagtgtatttacataaacctgatggtatagtctactacacgcctaggctacatggtatagcctatggctgctaggctacaaaccttatcgttttttattgtactgaatactgtcagagattctaacacaatggtatctaaccatagttaaccatagaaaatagacaataaaaataaagtataaaagattaaaaatggtacacctgtataaggcacttaccatgagtagagcttggagaactagaagttactctatgtgtcagtgagtgagtggtgaatggataggaaggcctagaacatttttgtacactcctatagattttatgaacactgtacacttaggctatactaaatatgcaaaacattttgttttttcaataatgaaataaatttagcttactgtaactttttatttataaacttttgcttttttaatttcttgactcttttgtaataaccctaagcttaaaacaaaaaaaattttacagctgtacaaaaatgttttaatatccatatctagaagctttattctgtttttaaattttttatttttatattttacctttaaaacatttttgttaaaagctaagacacaaacatacacattagcctaggcccacacaaagtcaggatcattaatatcactgtcttccacctccacattttgccccactggacagtcttcaagggcactaacatgcatgaagctgtcatctatgacagcaatgcattcttctggaataccttctgaaggacctgcctgagattcttttacagttaacttttttataagtaggagtatactctaaaataatgattaaaagtatagtctagtaaataaatgaaccagtaacatagtcatctatttttactatcaagtactatgtaatgtacataattgtatgtgctatacttttacaactggcagctcagtaggtttgtttacaccagcattgccacaaacacatgagtaatgtgttatgctacaatgtcactagatggtaggaatttttcagcacacacacacaagtatatatattatatattatattatatattatatatatatgtatatatatatatatatatatatatagagagagagagagagagagagagagagatggagtcttgctctgtcgcccaggctggggtgcaatgacacaatctcggctcactgcaacctgactcccaggttcaagtgattctcctgcctcagcctcctgagtagctgggactacaggtgcccaccaccatgcccagctaatttttgtatttttagtagagacggggtttcaccatgttggccagattggtcccaaactcctgacctcaagtgatccaccccactcagcctctcaaagtgctgggattacaggcgtgagccaccgtgcctggccaacaccattataatcttatgggaccactgtcatacatgtggttcatcattggccaaagcatctgtatttatatatgtatgtttcaaattatatatatatatatatatatatatatatatatatatatatatgatagctatacatgaacatacacacacacatatatagacatatatagcacataaaattggcacatattaagcattttgtaaatatcaaccattacaattgttactacttttctcagcaaggctatgaatgctgttccagcctgtcaaaatcacacctgtttaatgtgttttacccagcacgaagtcatgtctagttgagtggcttaaaaattgtgatcaaatagctggttagttaaaaagttatttcactgtgtaaaatacatcccttaaaatgcactgttatttatctcttagttgtagaaattggtttcattttccactatgtttaattgtgactggatcattatagaccctttttttgtagttgttgaggtttaaagatttaagtttgttatggatgcaagcttttcagttgaccaatgattattagccaatttctgataaaagaaaaggaaaccgattgccccagggctgctgttttcatttcctcattggaagaagaagcatagtatagaagaaaggcaaacacaacacattcaacctctgccaccatggggaactgggctgtgaatgaggggctctccatttttgtcattgtaagtaccaacaagagataagttataaattctctgacttctcggggttatcttggaactaaaatagaccaaagcttttttgttcatttgaggaattgtgttgaaactgatttaccatgtgaacctatatctatctgtaaacagactgagtccattcttccaaattccttaatggaaagaacatatctgggggctcacttctagcttacttctgaattcctaggaggaataaattagccagcatttcgcagaaggagtagaaaatatttcatgctaatgatctctgattctgagttgtttagtaatgtttactcagacgcacatgtctatgtgtttatactactttaaaaatgacaaattgaaattttataccattttctaaataaaaaatataagattgactcatgtatgggaagtaggcctttatttcagtaattacactaaatataataaaacttctcaaatttattttcaaaaacaagtaccttcttttttcagagatctaaacttgagttatttataagatttataaaaattcaaaagaacagaattgaaataagtcatctagattcataaatatgtagtatgtatatttatatataattgtatatatatataaatcaatatagtctggagaaactatgtaagtaaagatatagctaatttacaagtggacagaatgatttctgtactttttaaaacaaagaaaatcaactgttctcttaaaatggtgttatcagcaaagcaataatggacaaattgggtagatagaaatacgatttttaaatagcctttctaaataaccaatagaagcattacacagatgttaaaaagtacaattatgaatggaatatgaatggagcttttgtaaaaatttatcatgaaaaataatgagtctttgagttttaaatatagaaagcaattagtggcacaaataaaaacaacaaatattttgttataaaaaatgtttacgccaaaccaacattctactgcaacagagaattcttccgagtattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttagctgatgagaattcactagctggattactgtgtggtagagggaggtgattagcacctgtgagaacagaacgcagtgtcatactggtggagggaaagcaatagtaatatgttcccttcctttctcattttaagtggagtggcctgctatcagctacctatccaaggttaagcaaaagagaggggaaaaaaagggagtggggtaatgtaagactgataatttggtatactggccaaatcataaaacaatcatggggaacaacacagggtggagaggttttaattatagacaagtgtagtgacactgttgaggaaagagctggctctaagctggttatatccagctttgtcactacctttgtcaaagttggacttggggaagtcctgacccttatctgactccagtcttgtgtggaatctactgtggaaatgcggaaacttcatgcaattatttctgtttgtgcagctggtttggctggggttgaacgtcttcctctttgtctggtattaccgggtttatgatattccacctaagttcttttacacaagaaaacttcttggggtaagtataaattccatcccatgcaatattggctggttcacatttctcatcagacattcttgttcatcttcctgttagcattttaaatacatattctgaccaacccaaacagtaccattagcctcactccctccattgcaacttcctgggcaacagtcacttaaagccttccagtctgggaccaacaaaagtggggcagagggccccagtggcatccttccccaaccaagaaccatgtgccattgtttagcttaaaggagaaatctaatactcactctgaaatggaagggcaggttggagcaatccatccaggagtgacacatgtgggacaagtgggactttccatattttctaagtcacctaattcctagtacttttttgcatgaagagctctgctcctaatcacatgttatgaaatgatcttcagaaaataaatctctctctacatataaagactcgaggaacttgctcaagggccacatctgttgactaggacagtagagtgaaggcccttcagtttccttgggtcctttagtattctgagtttccttgaactgtcaggcctcttgcctccagaagacatctgttacatcatgctgaaactatgaattaattgcttaatattaattattataagtattataaatcataaataaataattttagcatataattatgctagatcattataattgttgttagcttattcacattgatgctttctcccgccaaaatatgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagttgatggatggatacaggaatggatagatagaatgtgataaagcaagcataaaaggtataatctgggagatgaataaacaggtatttattgtaaatttccttcaacttgtctttatgtttgaacattttaataataaaatgttgaattagggcaaaaggtcaatttcagatgaaaacaaagggtcctagctagccctaaaggaaaaccgttggctctgaaggaccttcctgtacagatcacttggtgtctctggtgtgtggcctcatgctaagaaccttggggaagtggggacagggcatattctgtgctcaaaaaagtcactctgctccctttcccgcctcttctagtcagcactggcactggccagggcccctgcagcctgcctgaatttcaactgcatgctgattctcttgccagtctgtcgaaatctgctgtccttcctcaggggttccagtgcggtaagagaaaatgttttactaagttcctctaattttcaaaggccatcaagcaaaatgcccttttttaggtaaaaacaaatgaatgatttgggaggattccagcttctgtagaatactcatgagccaagccattatctagtatatttctgtgctatttggggatggagctccctaagacaactatttggaaaacaaattttgaaaaaacacacaaaaccacctatacctcaacagtagcaatgaagtagcacacacgtacacgtttacacacacacacatatatatatgatagatatgcatatatacagagctttaggaagttgacatgtgatatctgggagttaatctttcagtgtcattcaaaaaaatttaagtcagaggaaatatcttctgtggataatatctcaaggagatggagtcaatggacagagtcacactataatgaatgtaaccaagaagtgttggcttcatggaactggggagcatagagctttctaaatgtccagaattcctttgactctcactccaacaatttagtaagccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaattggcatagccttggcttctctttgtattattattataaatatttttttgccacctgtgaccacaccaaagagggtagctgggaaaaaagtagggattggtgtcctggtgggaccaattccgtggttcattaatgactagtagcttctaggttttttttaaaaaataaaaggtatagtaagctttttgaaaaaaatacttattaagtagagatcacttatggaggacagcagaaagcaaactacttttgtgggaatgtagggattgtacagggcagatgcctgacataaggctggagaaaagaggtaggattttactggtaaactagaactgcatatgtatagttgaggagttcatgcttaatttggcaattacagaatatttgaaggaggcagtgaactaaactgtaataacaagcataacttgccttgaactctgcctcatttttcctagttacactaaattcatgctgatccagagaatttttttctttaagaacatataacattcaatttactaatataggactagaggctataatttagcttttattttatgacttaactatttacaaaataccatttcatcttaaaccaactgccaaaattgggctctcacaaatctaaagtacaagttggcagaaataactgttacaccttcgcttcctcagaaaaagaagaatgttgataaccaatttaagatgttccagaaagagtcgtgatatcttcctctgaaaaattctgtgatgaggttcctttccttaagccataaattctatgctacgcaatgttgtcttgcaaactgagagctaaccaaaaccaaaaactaacaacagtacttggtattaaacattgattacaaggatttccaaaaaatcttccaaatttaagaaatcacagaggtaaaattacactcaattgaaagttttattaatgagccacctattgtaaagtataacgtttaatatatcgtaagtgcccagtgaacatttgctaaatgaagcccatgcactatagcttatttttgagttgggttctctatcacccaggctggagtgcagtggtacgatcatagctcactgcagcctggaactcctgggctcaagtgatcatccctccttgacttccatacatgtggggattacaggcatgagtcacctgcctggcgagttccttgtttctaaggagacacaattcatttttattctccctacccccattagaatagtttctatttagaggaagtaaagcctgagaaacaggcaatgttttcaccaagatggcctgttaagaaatcttggttagtctacaagtccaaatttcactgccggtgagcaccatgtcccatgagcagcacatgttgtaatgccagcttttatgcctcctgtgacccaggagggaagatctgcatgagagtctctaaagacagggatgaaatgagactgcccttcaaatcgcagagaagcttggctgtataactacatagatctttatataaaagaatatgttttaaaactatcagcaagcaacattcttttatagatcaagcatgtactttcttctgggattcctaacctgaaatgtgaacttttctaataaaacttcttctgtgattgtgattaaaatgagtgagtgtgctgtaactaatgttggaaatcatatagctgccactcattgaagcttaatggaattcaccgcatgaaatctgcacatcaaaccagtaaagtgggaacaaaattaaatggaagtgttggcattcaaacccaggtcattgtgtccccagagcccattcactttaaatcatgctgccaaaacttcttgaaattgtgctgttgcagtattatgatcctagaaagccattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataaggataggactatgaagacagtgtatgttccacaacaaaaccatattcgtttgctttaaattcggcgtgcaggagccagtgaattttccccaaaaaatttcaaaaggatttgtcaacaaatagaaaagaacagtgtgtggcaagtatagacatgggggtaaattcatctctataggtttagtatgatcatctccagttccagggcatgaaaatgtacttcatttatgcagccaaataatgattaaaagatttttttaagtacatgacatactgtttttcacacaggaagcttacctgctagctggggagtgcagccttactaactgaaaacttaaataatgatactaaataacatcaaatattgattaaatacctgtcaatgaatatatgcaatagggatttgagggactaactatgataattatacaggtgaggaaactggagactgagtatgttgttcgatgtcacacggctaggtgggaggactgggacccaacataggtatatctgaagacaaaacttgctctgaaatgtgtaattcagtactgctttccaaccctactaattctcattctctgattctttggactccaacctagtttcaccactcctgtaaggactgtatcaatcatctatcgtgtaacaaattaccacaataacttaaaacaacccctgtttattagtttacagttctgtaggtcacaagtccagcacccagttgctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgctggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagagaaagaaagaaaggaagaaagaaagaaagaaaataaataaataaataaataaataaactataaaggaacatggcaattgggaaacaggaaaaagttatttcctcaaaattttaaggaatacaaagtagaaaataattttcagcacttgtaatgaacacaaaagacaaggaggctatataagaaaacaaagatggtcaacttttcaacaacagatcagtaaaatgtattttacaaataaatttttatttcaaaaacattaagtttgaaaatttgtattttacaagtttttatttcaaataggaaaccattgttttgagagtctgagtcattgctcagctccactggtgaacatttaattataaccaatgcattggtgctccaccatattccctaagcactggcacttccaatccatgcgacaactgccctttgcaagcatcattcactctctgcctggggattttctttcagctttctcctggggcaagcctgaaatcccaggggattgatgtcctgagagcatccctcagagcagccctcagccaatcatggatggcagttggtggttgaacacccaagcttcttaacccgttaggtaaaaaccaaagaacgaaacaaacaaagtaaatgaataaaaaaccctttgggataagttctacacagtctcccagagttccctggtgtgatcgagcccaatgatatgatatgatcatggtagctgatataataatgcactcttcattaatttccttcccagtctcatttttaccctcgttttctatgaccaccttccggatagaatacttacacttaaattcttgtcacaggtttctaggcacttagaataatagtgactatattcctgcatttggtttggtagaaaagggcattaaccttttatagacaaatagacttggatcccagccaatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattaaacacccctatatttaaattgaataaaacatttagaaccaaatattttaagtacataaattttctttggtacttcactctcttgttcttaaagttccctgaatctctgtgacagtgcatttagactatggaacaaagcaaccagagcaagacattggccagttttcaggagagccaagctctaattcaaccataaatcagtttaaatcagtttttttctttctttgagcattggcacgaattgagattcaaactcacattttctaacatatgtaggttcgtcaaatacactaaaatactgagtacaatagtatttttaatgccaaaggaaatcatgtaaagtatgaaatatcagaatgtttatataaactctagtatcagatggcctgagtttaaatcccagctctgcaacttattagctgtgtgacctaaggctaggtaaactctctatccctttgttttctcatctgttatgtagtaataataatggtacctcccttgtaccattattgtaagaattaaagagttaatttgattattacattaaagattaaattaaattaaatattacatcaattacattaaagattaatgtaagaattaaattagtcaatgcatgtaaaacagttgcagaagctcttggtaaatgttagctattgttattttggctattagcatttggtcaatgatctcccctgtgatgttgttcacctacatgggcaggtgtacccttctttctcctctcatagtgtgtatgtcctagaacagtgttgtttgaaaactattcacttgttctagaactgttcacttgtctgtgtccccacttgactatgaggtatgtgatgttaatttctacatcctttgtttaatgagtaaattaatcagaactagaaactatgtagctagatatgttttttgtacaagtttatatttttatacagttaagcaatggattccagaggagactttatgtcaccagtatgagaacagaaaacataccagttaagccagccatgtcacttactggctgtttgacctgaggaagatgactgcatctctctgaacctcagtttcctcatttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctggtaagtttattaaagaaaacttggaaccagggagttccctctattcatagatacctttttatataggagatcaaccagttttatagttagattaagtggtggttggatatgttgtatttttttaatgagttttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcacgtgtgaatttgtggactttttgcagcaaacctacaggagccatagcccataaattgagaatccctcaagacggtcattatcagctaaataccttcattattattattactattgttattgttattgcatgtatccatacaatggatatatatgtgtgtatatagatattatatgttattattaaaattattagggtggtagtgtcagtgcaagaagggctgtatttgggacccttatctaattccactaattcactcaacaaatcattcatgtgccagagaatatataagcacagtgataaagcagacttgtactctgcccttaaaaagtctgttcctagcctgagtaaaataggcttagattacaggcatttaactgagtttctcttctactagtagatctggcaggcttttttagcagtggcaaataaatagttcaaaagaaatatatgataaaatcttgttagaaactggcatagtgtacggattaagagcacatatttgcgtgccagaggtactggatttgattcttaactctgctgcttcctagcttgatgaccttgaacaaggttttaaagcagtctatgtcccagcttcctcacctgtaagatgagctgatattaatagtacctacatcattgagtcaatgtaaggattaagtcattgtgaagtacttataacagtacttggcatctagtaagccctatgtaagtgtttattaataaagaatgcaatttttaagacagagagattcataccttatggccataggtttgtatcaattcaatcaaatttgtcatctctctctggaggtaatttcagagtcaggttaatgggccagcaattaggcattcattacatgagtgttttcttgtttgagcccaaatatattatggagagagataatgagagcatatctaaacaccttcagaaactaaggctattgtgtagaatcttataacttgattgagtctttaggagcatatagctcaacatcttcatcttacaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaaaaagttggctaaccatcagagggacaagtctgtaggttacaataatgggagtatagaaaaaaatgtctcccacactcctcacctcatgtgtggaggtctctagatgttttccaggtctttaagctcatccatgagaatgtgtgcatgtgaagcctggagtaactcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttagaatttaggattctgttagatggtttgggggaggatttaagaatgcaaggattttctctggatcagttatggtcaggaattgggggtagttctcagataaggtatcttaattattttttctaggaggcagagggaacagaataggactaagtctataataggcaaagaagcagtagtcattgtctaggctcagacatgattttggagtggttttgcttttatctcactccatcacagtcacagagtgacctcctcagaagctggtgttttgtgaaattatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacattattcattgtttgcccaatgatatatgagggtggcaacattaacataactaggtaaatctacactatcatgctctattcagttgttcctggatcacttttactgtatctatgctctcctactcttctaaatgttttcattttcaataacctgtaactgtttcctcctcagaggactgccctggggctactaaagtcccttttctcacaggctcagagatcttggaaggttggtggggggtggctgaatggttacctgttcctgtgcaaaccgttagccaataactggtggatgcagactatgaaacctggcttccttgccttgagacaggataaactctaagttgtaacttaccctccagagttgccttgcaggatcaggctgaagctatcccctgtgagactgcctgatttcacccccttgcttgacttgtttgtcttttctatcctattccctactctcttaccagtttctcttggagcacatgttttctaagtcacttgcccatgaagtctcatctcaggatctgcttctggggagcacagctgatgatgttcagcattcccagaatatatttgcaaactaagcactgtggccctttcaaaatcaaagggagaaagagccttcagacacttttaggacatcctgtagttgattgatttcctttattttctacccccttagaaataactatttaagtacatcagttcacatttcctatgacatcttaaccatgtaagacattttaaaatttagaaacatctatttcaaatctatatctgtctgtgagggatgattaggattattcaaagagggggtgaaaatatctattgttctatacattggacactttataatagtcctgcatttgagaacctataatattgtgcttgcgcacatgtgtgtgtgtgtgtgtgtgtgtgtgtgtgtgtgtgtgtgtgtgtgtttatattttacagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattctgaagtgaaggatttcatgtccctcaatttctaggcaggatgctccattagaggcacagtgacctccttgcctgtgtgtggttagcctgtctgctaagggaatgtgagaggatagcagaggtcagtttgatagaaaccagtcaacattggcatttttgtttcatgcacccatgtaattgctattcatggtgaagttatatatagcaagcttgaaaaatacaccaaagtctgagtatctttgcaaatgtataaaacatattgagagcactggtaggatctggaacatctgcaatgatatcctctatggtttaatcactagtaaattaaacaaacctccagactagaagagttaatgattaatcagttgaagaggtttgttatagttcaataagttttgatttaagcccacagtcatttatttgttgtctaccatgtatgaggacctatctcaggcactgcaggaaatacaagcaggaaaaatatgtggttgttgccttcaaacattctaatataatgaaagtagcagctaacttctattaagggtctgtgctaagggtttgacatgatatatttcttttaacccccaaaatgtatagatttctcactatcaccatttcttggggatagtaattgcagacaagaaacctggagctaaaatgttaaaatatgcagcctaagccacctctctggtaagtggcccagctgagattggagccaggcagtctaaagcaggctgtgataaatgttctcttagagacacacagttcctggctatgtggttaggagagtttgcctgattggagatcctctttcataccaagtttccttttttgtgcagtttcataccacctgcacacaaaggcaggcctggggaagttccctggtgggtatagggctccaggaaattagggttggaggaagtagaagctcaagactcactctgcccagagcccagttggtggccaagacatgactgtgaaaaaggggaagggtggggaaagctgcattgggcactgcattcttaaactacttgctgactgtgacccctgataaactctttgtaagcatggagaaatcaatggagaccaagaatctgatgactctcttaaagcactcaaatatctttaaatgggacttagtcataatcccgtgtttcaggtaatcctagagaagagaaataatttcttcccctctccaatttagtaattccaccactttctgtttgtatggtttcgcagatactcatcttcctttgaagcagacagaggagatatgtttatctccttctccacttgaagagaatctgctctttacactggttaggtgatttctcacagtctcatggctccgtagcagctgaattgggtttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccaagcctggcacatgataagtgctcaatacatgataattctcttccccaagacctaaggatagaaaggagtggttaatgaacttgaattaaaacattctcagaatacaccaaatgacacaataaattttaggtctccaaaacaaacctttacaatgggttttctgtgtcttttcttcttatatattctgaagatgctgtcatttatgttccttgaagtctactcaacgttgggccttcctctctctatcaccaataattgtcttatgatttggtagttgctcaactagcatttattgaattgaaatgaatgggctctgagcaattcaaggtacacactattagtgttgatgtctgtgagaatgttataatccctatatagttaagtatctcaaactggtttcaaaatttggtttgatttagataatttccaaacccacaaataaggcacttcttgtaagcttcagggctactgtatatgactgtctcagttgtctactatagtgggtgcctggccaaggacaataaagttagcccacactttgatgattgagccctttgcttatatcttcataggaagggtaccattttctaatttgcacaaaggcactgtaggggccagcagtcactctgttagatttgcaatttttctgcttttgtttgtttgtaaatgaaaatgatacttgagacagaagtagaaattctcccttaagagaatttgatccaacacttaccctctataatgttacatgtaaatatccctttggtaattgcacatatattttttctgttgctgagtgttatgcattttctttcctttcatctattcagagggagcaataagctatcgcttttaagtgaaaagtacagggcctacatcagagcacttaaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatggtatgtacaattcattgttgttattacagtttcattactgacaatctttaacctgtgtctaagaaacatgtacagatgttatacatctatatagatgtccattacaaatgtcatggaacagctaaaacatgtgtctacttttctctgctatacttattggatagaattgtttcttgaaaactaagctttgcattgttctgttattaacatcctgatataaaacttgggaaaatagtgtttttagaagtgctgttttggttcaagaagttccatctcttttcttcatgacgacgccagctaatgatttttagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgtggtgggcagaagtgtggcaagggtgaccaaggaaatacatggtgaaatactttcttccttctattgggagctctgaagggttccattttgtgtattctcataacactgctccatagagtaagatgtgggccttgtaatcttcatatcattttccccattggcagatggtatactttgttggttattgtgctagccattggtataaaactaggcaaaaatcaacatttgtgcagggcttctgaagaggattatttttttttccttaggcacagtataacataaaggcaaattttccattccattttctcctttcttttttcctactctcttagcataggagcactcttactctagacacagcatactatatgaagacgtaggatctttaagcatcttttcccattaatggaagcaaccagacatatcagtgaattggctccactacatgcagacatcaatagaaaggataaaaagggaactgtattgccaatcctcttgtgggcaggggaaggcacatttcctcgatgacagctggagtcagagtactagtaccttagcagaaacctacctcaaagaatttctaggtatactagcagcaatatccaaatctggctccattcagtggggctccatggtagcactcaggaaacagatagatgatttgagactgttttatatatctatcccattaaaacaaaggccaacaacagaacattgtttatatttggggcaaatattcttcaagtttggctgaagatggagagattcaggtgctctcaatttccaacagtaagtttcctataaaagtaatctagtagaaagattatatgtgagactatcggaagcactctcttatcttttcccccttagaatacattccggaaagtcattttttagataatattgctgtctaaaattctttgctagtttaggtattaaactagaagtccaattggctgagtttcaggatggatctgtttgacctcaatgtttttatatggccaataatgctacagagtaattccagtgttcagaaacactgcatgttctgacccaagaaatagctaaagaagtctgaaaagctctaggtttgtctccattcagcaagtgcattgcatactcccagaatttctcagaatattggagaaacagccaaactcttgcataaaatttgtcatcttgcaaatttgtcactgtgactacataactaagagaaagcaatcacagtgttgcattaaaaatattgtgttgctgaaatgttatcctttaaagaaatgttaattctgaaaccaaccttgctttgttatagggttactgcaactgtagttgcaacactgagaggaaatcccattcttgtgaggagttcctcttgggaaagttttatcttgtcagtacagttccccattgtgactaaggagaatgtttacttttactggctcaaaattatcttagtttcagatattttcatatattccattgtagaagaaatttatttatctaatgtcaaatatttaagcaagcctacaaagattaacttggcttctaaaatttttctccctctgaatattttgttatctattaccacttaatgtatctcattttcatttttgctctgattacagacttggaaatggatagtgggtcccatgtttctgtatctctgtgagaggttggtgcggttttggcgatctcaacagaaggtggtcatcaccaaggtactgattggtttagtaattactagtggtcagtgtctaactatatcatggacaagtcttcccaactcctctatatcattgatcagatgttacaacagagagaagacctacaatttatttcaatttacttagctcaataatcaaatgtttgagcctttaactggggaaactacaagttaccatttttgatgttaaaatgaagccaagttctttctggacatcaatctcccccacccattgtgtgtgtgtgtgtgtgtgtgtgtgtgtgtgtgtgtgtgtgtgtgtttgtgtctgtgtgtctgtgtgtttgtggaggggaaggcgacagaggcattatttggttagttaagagcagaaaagaaaaagaggtgagttcaaaggggcataaattgagtcttaaaattttcagatgccaaaagaaccagagatctaagggtaggtctcactgaggctgagctagtttttcaggttgtctttaccaccttttctgtgctgtgtatgtaataatctaataggaaagttgaagtgcccaaaatttcaacaagttagtaaataagctgcctctcaaatttgctctcctaattccaagtctagagtggcttttcctgaactctaatctgtttctcatcacaaaataaataaatatccaactaaataaatgtaaatggaactccttgttataatttcaggaaacactaggaaagtctatctttatcaaataaaatttaattcaattcaactcagttcaaaaagtatttgccaaaaccctactgtgggttatttttgcaaaacacacaaattcttcctgtcctccaccctatctttcctcatttgctgtctatggtgggtcatagtaaagttagttcagctggctttggaagtcttgaaatataggaaaccacaacagttctccttttgtgatatttatattgcattataagaacaatcccacagatcagcaaaaacagttgctgcaaaatttcccttactagactagagatgactgagtcagacaagtatttttcttaaacatacttttaaggaaaacttgttttcctttgaagaaaatagatatttgttttcttctcatataaataaatatgagaaacaagatgttatccaaaagtattccaatgagaatgctgtccacttatttagttacatctcatttgtgcctatgatagcaaaattgtaatatggtaaaaattttttccacaacacaaaattgcaacatggtaaacaattttcaacataattttaattttctgttttcaaaatgaagctttacaactccttatttcagaacagaagggaagtttgttatagtttttatcatgtaagatgcatttaaatcacaagttctggaaacgtttgacatttttttaaaaaagaatttttcactcttccacaactccctgttcgagaaaagcccagcaatatcagttaacattaggaagctgctattttatttctattgatttttctttcctttgatgtcccttggtttgtctttaattatacatataaggttcttctagaagtcttaggaatcatcaaagaaacagtatattactttctgtattgctcttcactgtgttctattttttaaaaaaattatccagtcaatagttgatggacatttggattgtttcctgttttttgctattatgaataaagctgttataaacgtgtgtacgtagacagatgaggatggcaatgggtgggtagaaaagatggtgtactccccaggtagggagaaatgtagaaataacgcatggaatcaggcagattcaaggtgtgattcaggacaaagatagaccaacttagttagtcttgttttggggaatgttgctacataactagtcaatgggatctccttcttctggccagctattaggttggtgcaaaagttattgcggtttttgccattaaaatatggcaaaactgcaataatttttgcaccaacctaatactaaggccctctctcatcctcttgggggataggaaggctgagcaggaaacatcagtttttgtaaattttttagcacttttttgacttctgagaggaaaaaaaaatcacaataggctgatttcttatgttggattccctggtaaagactgagaaataactgcatgcagaaggtttctaaggaattctataagagataaacctggaaaggaagtaagaaaggcaggaatggggagagagaaaagctgatcctctttctagttgtaactgtggcctcagctgatactacagggagtgtggaaattgagatggcctcttggagttaacctaagttaaggaaaagggactaggccttagtatcccttaatcagcccatcattagtaatgggctacaactgagggcaattccctgtgacagacacatctgctggaggaactcctgtgttgtccctaaagcagagatctaagtgggccaatttagctcagttttttatccatatggacactaaaaaggcaagtatttaggaaaaatgtcatttccagacatatgttttattctataggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagtgagtaaaaagtacatattaccaacgtatatgagttcaggaaaaatggcactaaatagctcctcttcctccatgttttactaagtctccaacaaaacacacaggttctaagaatataggtagctatttctgtggtcaccgtttcatatgtgtagtgtgtttatgcatattttcataaatcttatgtgaaatatgaaaaccttgaatcaaatattagaaataaatactcccaaattcctttaaatatgtaagggtcaaggccaagttatattaactttcctaacaaatataattgtagtgtatcaaaaatattcttaaattttcattggcataatttatttgaggttaaatgccatatattagcccctttgcctccttttccctgcatgcctaacatgctataaggcacttagtaggtgctaaagaaaggtttgagagtttgttgaataactcaatgaatagataaatgaaaagtggagacattaaatctacaagatgtaatgatgcagcaaatcctcacttcagggtgcaccgtatgcaagaatttcaagagtgggatgtcctggcaagacatagggtgtgtgtggagggggcgttgttgtgtgtgaagaggggtggggagattaaaaaaaaaaaaaacttgttctgagttaccgaatgtttttggttagccaaatatttctctttttacttccaaacccaacgttggcactaagtttggttacttgaaagctatttcatagaaggaagcacccaatagatacattattccaatttgaattaacatgttgcacatccccaataattatgggtgccccatctcactctgaagagcaagacatctctgtaactatctcctccccatttcccttcaggatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaaggtaagtcctttcatttatcggagggccttagagcagtaaccatactctgccatgtgaggcctgagagtgctttcagggctaaggttggcagagaccatgggaagtgaagaaaagcttccggtggttccagagagacaggcttttcttcaaaagaatatttgttaaatctaatgtgcttctagataagtaggcctattagtgaagggaatatattgtatttgtatagtgttgctggaaattcagaagaaagaaagttgggaaagtattcacagccccaacttaatagctgtaatttttgtatattctcttctaatattttccatgtttacatatttttagaaggttgtaaatattaagtatgtataatttcatgtcctgcttttaaaaaaacattatagaaagtgtttttcaatgtcttcacaggctttataatgatgactttaaatgatctcttcatgttctattgagaggatattgaataatttttctttcatcttgtgttagatactgagattgattcaatttccagccgcgccccaccccctccactcacccaatactttttttgcaaagggaggagaggagacctgaaactctacttatgaatatctcctcaggatcaattcacaggagattttttggttacctataaatttggttttattgtgtaataaagggcatcctaaataaacctcaggccattctaataactgtaaagataaactctaatagggacattaagcctaccttgacttttcattctccctgtacctcttttccatgtggaggagatgtgcatagaaccttatttttcccctcggaactcatgaatgtctggcagtagcagccagggaagaatttctgtggcaatccctgctagtctagattccatcaggctttctgagaagaggttcgaaggaagccagagattctgggagagtaagagcagactcagagggaaatttggtgggctaatagttttttcttaagttgtgtatttctgaggtcaagttacttatttactgccctgctagagtgaaggccagagcaggttcatgtaaactaccctgtgaaatgtccagagccttctgaaaatctatgtttctaggcattctgagcatcaagaaaaagtttaggtgacagaaagtggaattccacatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggtgtgtcttgtgtactattttttctaagtatgtttagtggatttggtgatccggtccattcactctcatttagtatcgccacattatatttagactgctcagattagaatcaaagccaaggagcctgtgagggaataaaagccatcactttgacattattagagcaattctcccaccaggcactctgaaaccaggtgattgagatgatgcacagggttattttggggaaaatttagctttctctttctctctgtctctctctctgtctctctgtctctctctctctgtctctgtgtgtgtgtgtgtgtgtgtgtaaaacagacactccccaacttaataatggttcaacttatgatttttcaactttacaatgaagtgaaagcaatatgcattcagtagaagccatacttcagtacaagccatacttcagtactgtattcaataaattacatgtggtcttaaaccttttattataaatagggttcatgttagatgattttgtgcaattgtaggctaatataagtgttctgagcacatttaaggtagtctagactaaactaactatgatgtttattaagttagatgtattaaacccattttagacttatggtattttcaatttagtgatggttttatcaggatataacaccattgtaagctgaggagcatctgtttatataacatacataagcatataaaggattctgtatatatatattttaatatgtatttatatatgtatcatatatatttatatgtactatgtatatatgtatttataaaatcatttaatttatatgcttttgtatgttttataatatactcactacatttataattattatgcatatatattgccaggtattattcttatgtatctagtcacatagattgtctaattttatcatgtcaccaaccctatgaagtagctcttattattttccacactttacagatgaaaaaactcagaccaggttaggtcattttcctaagagcacccaacaagtaagtgacagagacagaatgtgccagagcctgtcctttcagcatcttgcagtagttcatgattatcatttataaataaattactatatatctaatgaatgtgatatatatgcatgtatgtgtgtgtgtatgtgtgtgtacaatgagagtgctctttcaaaaatgtttggagaccactataataaagtagccaatagttctcaactgggacaattttgctctgctcctccccaagacacacaccagagacagttggcaatgtaaatatcctacaattaaaaagacagccccccacaacaaagaattatacagtcccaaatatcaacagtgctgaaattgacaaaccctgaaacaaggtaatgattcctggagtggtaacatctttgtaagtaagcaaacgttaatgacttggcctggaagcagcataagctatcaccatgagtgaggagctaaggcaagagtctctgcatatttctgtccagtgtctcagctggtgtcttagtccatttgtgctgctataacaaaacacccaagactgggtagtttgtaaagaacagaaatttattttctcaaagttctggaggctggcaagtccaagatcaagacaccaacaggtttggttgtctagcaaaggctgcatcttctgggtgggagaaatactgtgttttcacatggtggaaagaaaaagggaaggctcgtcaaatactgtgtgatgactcttttccaaagcccttaactcattcataagggatgatccttcatgtcttaatcacctttttaaggctccacttcttaatgctatcacataggcaacatctgaattttggagaggatacattcaaactgtagcaactgggcatacatagacattgactccacaaccctgggaatcttccatgtgcaccctgtcactgtgaagactgaattcccatttgggtttcaacatattgtttatcacagattctccaagtcttaaaggaatcttgtagcaaatatagattagggaaacataacgataagaattgttgctccataaaaagtggtttcaaaatgccagttctgcaatttaaaaacaaaacaaaaatgctttgataaaaataaaactcaggaaaaaaatctatagtatataaattgctttactgttctgttattttaaaagccatgcacaggtttcttttttaaatcagttatttatttgtattgaaaaagtaattattttgctttgcaaaactgatatctatagaattattaaattggagtgcccacctttcttaacctcctctatgaccatcatccatctagtgaatttcaaatctgatttgctttttaaaaataaatttaattaaccacttttatgaaaaatacctgttgctcaaactgaagcctcctagaatggtagcagaaaaacagtatgtgactatatacacatatgtgcgtgcacacacacacatacacacacactagctttaggcttgatttgatgtcttatgctaccaaagtattgctgcattttagtctaaaattgttacatctcttagtaattctcccaaaggagtggaagtatattagggtggagagaaaaagtcaaacatagagcagagagaaaaacagtgagacactattcatccatcaatgcctgactcaaatactgcggccctaacccttcccctattcttccacttcaccttccttctttgttctcattaggacgcttgtgcctccttcatgacacacatcataccctgttcgacatatgggattatttatatttatacttcgaagtctccctttctagactgtaaattgcttgagagagatccagtttatttatctttgtttacctttcagcatccagcagggtgccttggttagaatagcttgtgaaggatgtaaatacattgtatgtgcttttacagaatgtctcttttttttctgaattcatgtcctttcctgtaggccaatcactttgctgtgcaccatgatgaggagaaagatgtgatcacaggcctgaaacaaaagactttgtatggacggcccaactgggataatgaattcaagacaattgcaagtcaacaccctaagtaaggagtctgtcaccaagatgtttttgaggcttgcatctgcctaaagcggcagcccctatacatatctaaacttatatattttagaaactcaaatatgtatattactatataaagattgaattcatgcccaacagaagattccagatatcttcaactttaagaaggatctttaaattataccaaattacctggagattaattaaaaacaagtatttccaggtccccatctcagattttctcaacctgcctgtcccaagtagggccacagcttagttcttttctttagtcacctaaatttcattagtgtatctacttcttttaaagattcaatataatttatacatattgttaagaagacactgtccccactttcagttctaaaagcttctgggtctaaaatcttaagttgacagatgtctcaaggtgctttctgctctcactaaaactttagtcattataaaaccttgagggggatcccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttagcttgttcctaatttcaagatgccagggggcacagagccctgaaggaaagtagcccacggactcatgaattcaccaccattttctctgtgatagaagtttccaaaaaccttggttggattttacttttgccagggaagtcaactaccttttgaactatccagatgctcacacaaacaggctgaaccacactccctctgagcaatatgatccctttgctatttgtggaaaagaaaaaggagcagaggggactctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttctttgtgtctgtgttactgatctttgtattaaagggtaaattcagctagtaacaattttctctaccccggtggggttgagacactctgtgtttctgtatatgatatgccaaacacttcatggtttatggattgggaagtgaaagctgaagactaagttctgtgctgaatactgttgatcctcacaacactaatataagggacagggagggcaacttaatgtcatagacagaatttcagaaacgaagaagccccagtgtgacatctttgttccacgtctactgaactttcatgttctaacttcacaattgagtatcatcaattgtgggcaatatgggcaattgtgggcaattgtgagcaattgtgggcatatatgctcatgcttctgtgatagcccttgttctaaatgagtcaaccggttacgatctccactatttaggaaatgcataggggtgtgggcatgacatgttcctgtgggagtcaacaggtgctgccatggagggaaaggacattacctaaaataaatggcagtaatagaaatagccaacatttggtaaacacctcctactatgccgaacattttacatacactttatttaatccctcagcaacactacaaggtagccgttttatcctaattttgttgataagaaaacagtctgaacgaagatgaatgagaaggaaaagtacccataactattgggtgactatgtcaacattcaatccacatctttctggggacaaactccatgtcctttatactacactagcagattacactaggtataaaaaattaaggatattttctttctctctctctctctctcctttttgtttgagacggagttttgctcttgttgcccaggctggagtgcaatggcacgacctcagctcaccgcaacctctgccacccgggttcaagcgattatcctgcctcagcctcctgagtagttgggattacaggcatgcgctaccgcgcctggctaattttgtatttttagtagagacggggtttctccatgttggtcaggctggtctcaaactcccaacctcaggtgatccaccggcctcagcctcccaaagtgctgcgattacaggcatgagtcaccgcacccggccaaaaactaaggatattttcaaagcaattatgctaggtacaaattatgtaccaagaatagctgggtaacagtggtaacataaatctctagtttataccatttaagtagcttggtatcttagtttagaaacactggttaatctgattcatgctcatttttacttttaaattatgataaaatagaacctatcaaaaaatggaattattttgcttggagaaaagaaggctgtagggtgactcaataatatttattaagtctactttttcatttatatttattttatttataaacaatttctgtctttcagagaatggccagctgttgtctatagttttgtgtgtgtgtgtgtgtgtgtgtgtgtgtgtgtgtgtgtctgtgtgtaataagattgcatgaggaaggagctaaatttctcaaccataaattcagttgggcaaaaaacaaagtgttgacagaggctaggaaatctgaccactagagatttttaaaacctggaaaaatgatcaaccaagtggcctgagattcatttaaacttgtagcctttattatcttgttgtagtggttggggaatgaggtagtctaagtaattggatattccagttaatacttattgctaatagattcataattttcaaggaagtgggatgctataaattataagaagaaactaaatcctgaaatacacttcttcttggatttaaaaaatactaggaaatgttgtacatgagcagaggccactgtgagcttattttctagattttactctgaagaactaatgacatgaagactgtgcttatctgacttttgaaaatagcccgaagtattttcttcctacttcatagaggactgctccaaagacagcaaacttgatttatataagaaataaagtccaaaagatcttcataaatcttaaaattacattcgattataaagaaatcaccaagtttagcattatgttagatcccttgattgctaaatatcacttcctcttttcagtaataataaaatcactaacctacttatgctcatagaaaacactaaacatcactttttctgatcagatgagggcaagtcagggcataaggaatgaaaacgacttcgttatttccaagagattctagggcaattcttagaaatctttatgtcgattgataagaaaaaaaaattatgctacctaaacatctcttgggaatagcaaatgtgcttgcattggctgaaaaccatcagggaacactattaacatgggagttattccagaccaagctattggagatcagcacagctatctgattatcctgttttccaggtgggggctctgcataactcgcggctaaaatatcacactcacatctatgttatcaacttcctgctgcattccttacccagtgcttattccgctgggacaaacatgcctatggctttactgagatcgaaggcaacagcaagcttgaccatgcccaactcacaaagaaagtcagatgcaaaacagcctttaagaacatgagtttttgcccttcctttatagaaaataatcacaaaactttcctttccttttggtaaatataaaaatgcattttgagaaattcatttcctctttgagatattgtttatcaaatggtgaggggatgggaatcgggggaaaatgtaaaacaaatgaatggtaaccatattaatagaaaaaacaagataaggaatataatgaatagtgtgttttttattgtttttttttaaacagtaatgcttgaattgattgcaaattggctcagatttccgacttctccctggatccacatcctctgcagtgtgactttgtaattccttccatcatgaggagtccttttgctcatcccttgaatctgggctattctcataacgaactgaccaatagaatgtggcaaaagtgacgtgtgagttccagagtctaggtctcaggaaacctagtgtgcttctcttctctcttttgcttctctaccttttccatacagaatgctcaggctagcccgctcaagggtgcaacctatggggcagagcagagtcagcctacttagtcccagccctaagaccccagatatgtgagagagagcccaagactaacaaaactgcccaggccatccacagatgactgtagatacatgtgtaagttcagttcacatcctcagaaccacccagatgtcctgtagatgcatgagaaatgttaaatgcttgttgttttaagccactaacttcagagtagtttgttatataacaaaaccgctgatgcaaatggcatcaaaaattgttgaaagagagatgggggttcagggtgagagctgtaggtgattgtatctgtgctaataccacatagcccttttttggggattgccatgaataatatattagctttgctatgagtaaaatactatatcctctgaattgtcatgaattacgtggagtcatacgtgttttggaagtgtgaaagtccctgggctcagataaaaggtgttgccatctggaaagtacaggtagtttatttcaattctgctccaataactagcacgtcattccattcatgtagaaataagctactggctatctcactatctgaaatagaagtatgaactgtgggtaagtgggtgaggacaatgtctgagcaaccaaaaaggagctcaaatccacaaacggtacattaaacagtggcgaagtcagtcagaaattcactcagagttgttgtgtacttgccataaccagcttagtcatgttggtcccaaagtcatagttgatgagaagtagcaagttaagagagaaagacttctagagataggtacatacacaatgataacaagtgacatcagagaacctaaggaagggcaaagaaagaaacactgcaaagcagactcaaacacttaaaagcatagcagcttggggccagttagtgtaagagaaaaggagctccatatgcctcaatagaacctaagagcatcattgtactgcatttattcattcattcacttcacatgtttattcaacaaatgctatgtatactgagatttttctctggtcattgtactggctagaacctaaaggagtgagactattaattagagtttacaatctggcaatgatattaacagtctattcacaaaagggttaactcaagttaagccggcctaaatgtttatgcaaaataggatttttgcctaagtctaaagggtatcagaaaagtgtagccattgagaatgactcatttcatggtgttctcggatggcttaagtattattaatatgtctccatttctagtgcaggaacctccacgttttagaggaaaggaggaaagaatttgtgaagactgtgcctaaaaaaggtagaaatttgtttacaatttatttaaagataaaagtaaagaactaggttgctttaaaaaagggagggaaagaaaatcaaaatacatcttatttgaggcattaaaacttttttaagaaaataaaatttaaaataaagttgtattcttctaaaaataattttttaaaccagctgaaaatgaaaaatgcagattatactaagaagcaactgttttacattctgctttctgaatggtatttaaaaactcagttattttcagaaatgaggaagtcttgatctgctagatgaaggtcggctgcaggtggtgtttattgctttatgatggcaacaaaccgtaaacccatcactcagtaaatattaaactggctgaatgaatccaaagcatgtctaacatacaggaaaaacacagccctgttaagcagtcttgaaacccacaagctacatggaaaacacagattcaactacatcataaaaattcagacaattctggttcaggatgaagaattgatcctaagcaattttctttctctctctctctctgaagactcttaaatggcattttaaaaataataatggggccaggcgcagtggctcacgcctgtaatcccaacactttgggaggccgaggtgggatcacgaggtcaggagttgaagaccagcctgaccaacatggtgaaactccgtctctacccaaaatacaaaaattcccgggcatgtggctcacgcctgtaatcccagctactcaggaggctggggcaggagaatcgcttgaacccgggaggtggaggttgcagtgagccgatatcgcaccactgcactccagcctgggtgacagagtgagactccgtctcaaataataataataataataataataataattagcatgtcttttaattagcatgttattattattatggttgccaggtgcagtggctcacacctgcaatcccagcactttgggagactgagacaggtgtatcacctgaggccaggagttcaagaccaacctggccaacatggtgaaacaccatctctactaaaaatacaaaaattaggtgggcatggtggtgggcaaatgtaatctcagctactcaggaggctcaggcaggagtaatctcttgaacccgggaggcggaggttgcagtgagccgagatcgtgccactgcactccagcctgggtgacggagtgagactcggtctcaaaaaataaaaaataaaataaaaataataatgatataacctgtgtaaagagaacagaagaggactatcgagaaataaaaatttttaccatgttcctagaagctggataattgatagagaagtggtaaattatgaattaatttgaaagaaataaaacttagaagtatttgaggaagggacaaggctcaggaagatgcctatctccctgaagaattccagagaaattagaggcatggaaataccagatacaaagaaggggaagagtgaaacatggaaatgaagagtcaagtctgtcatccaactgacggaagtttcagaaagagagtatagaaatagcacgtgagagaaaagtgtcagaaattataagatactttatctgagctaaataatacaagtcatcatacggatagagtccacagagtagccatcacattgaaaataatttcttatgtctagacatattattacaaaatttcagaacatcgaggttcaagtaaatttgcaacagcttccagaaaggaaatattaaagcaaaacaaaacaaatcaagacacagctaacccataaagtagcaagaatcaaacttgtttcagcaacactggaaactagaagtctatggaccaagccctatggaccagggaccacatctgagagagaaaaaggatatgccatctgtttatgtacatatgtccatgggaagtttcatagaaactcagagttctgctggaaatgatattcaacctagaagtctttttttttttttttttttttttttagatggagtctcgcccttttgcccaggctggagtgcaatgtgcaatctcggctcactgcaacctccacttcccaggttcaaacgattctcctgcctcagcctcccgagtagctgggattacaggtgcccgccatcatgcccagctaatttttgtgtttttagtagagacgggtttcaccatgttggtcaggctggtctcaaactcctgacctcatgatctgcccaccttggcctcccggagtgctgagattacaggtgtgagccaccgtgcccagcctcaacctagaatactatacttggctagcttagcctaggcactctgctaaaaagcaaagttccaggcagggattaaaatacttatattttgcttgggaggtataagcctaaggtggtgagcatgagaaacccagtaagtgaggcatgggaagatgtgaagcatcaccgcacagccaccaattcacaatgagccccaaagaaccatactcagcatgtgtgtgtgctcagtacaagggtgtacccttcctatctgtttttcattggtcaagattaactccatgatacaatacacactctcaccccccacccatatacatttctaggttacatcatccagcctcagtgacaggtcaggaactagaccttacactttgcattgggacattacatccaaatcgggaagaagaggggcaaccccacacagatggggctctgaccatagagggaaagaaggtacactaaaattaaccttacctaaaattgcatcattcttgagaagtcattgaggttgtatttctgaaaaccaaggaagtaatctaaaatgaatgaagaaataagacctaaaaagcaatggctttaccccaggagagcaaagaatgttctatgattatggctggacagttggctctgagaacaactatttcagacagaagcaggggacaatgctccaacaagatctacaggaacagcttgagcatatggtgaaagcatttggtgggagttttaaaaaagaatctattcaaacatcactctagaaatattccctttgagtggtatagtcatgatattaaattcgtagagaaagaaaaatactcctagcacaccactcaggtcaatgttgaaaagatgtctttcataataatgtaaatgtgtattgattttctaattttaaaattaattaacagacaaattacagaagacttagactattacaaaatagaatgtaaagttatcaaccatgacaatataaaagcacaatggaatgggtggaatattgaccacacctgagggagaaaaaggatatgtcatctgtttatgtagatatgacaacaggaagtttcatagaaataatttcacatgcccagatgtgtcacagaagtagctgaaagacactggatctgatagggaaaatggacagattacactatgtccaagggccccacccaaccctgttgacttatataagattctggaaccattactcaaattccatgggtgacagtaagtctataatcctaaaaagactgggattagttttcctgctacatgatagaaggtgcttaaaagagaattacactttgttagagaaaaatagagtcatacatcgtgcacacctcagtttggagacagctttacaactactctagatgtgtgcagttatttaatgtaacattgaaaacattctaattgttcatcaataagaatttctagtacaatgtatgttcactgcagcaccgtttacaatagcaaagacttggaaccaacccaaatgcccatcaatgacagactggataaagaaaatgtggcacatatgcaccatggaatactctgcagtcataaaaaaaaatgagttcatgtcctttgcagggacatggatgaacctggaagccatcattctcagcaaactaacacaggaacagaaaaccaaacaccgcatgttctcactcgtaagtaggagttgaacaatgagaacacatgggcacagggaagggaacatcacacaccggggcctgtcaaggggaggaagagcattaagacaaatacctaatgcatgcggggcttaatacctagatgacaagttgataggtgcagcaaaccaccatagcacatgtatacctacgtaacaaacctgcactttctgcacatgtatcccagaatttaaagtaaaattttaaaaaaagaagttatagtgtatccacacactggaacacatgttaaatagtcatatagttagatctatatgtgtgactctattcatgttacaaaacaacactctacgtttatgtgtgtgtgcatgcatgggggaatgggggcatacatgcacacgcatgtgtttgggtgcatatcaaaggtctggaaagacacacatcaaagtattaatatgataatctggggaaataagaggaatttgcgttatgtgaaagggaatttttatttttactttatattatgtatgctttgttgtttctgaggatattttaattcagattatgcatgatctgatttgtgcacatatattgtttataagatgttagcctcttctaaattttgataagaaattcatttccaggccactcatgtcatccctgtttcaaaaacccttgaaggcttcctgctgcttcaagaaagagacttaactccttaatgtggcttaaaagagatttcatgatttggcttgtgtttactccttttgctttacttcttcatttcttgatagtatacctactgtcaagggggcaatctcaaagctcttccaacctgtcacagcattatgtgcaaagtccataaactttagttgatactgagacgtttccatcatttctactgtcaagccagtcaattctcagttaacagcaaacaacagactactagcattatgttttccatctttccctccaaatctacacattcaataggcacatgattttcttcccaagtgactataggcaacatttataacaaatgctttgcctctgcttaacagggatcttcatcttttcagtcttcaatatgtttccttaacacccaccaacctaccactctgtcaaagtcactcattttagattttgttatagtatgccctagccactgtatcaatttctgttttacttagtcagcacctggttctgctgaagtaacaacccccaaaatctcaatggcttaaagcaactagagcttatttattgctacattatgtgatcattgcatgttgactggggccaacatttttctttcttatggacccaagctaagatggactctatcttcttgcttctacaatgtgcctggaactttacatacttcatcttgtttaatcttcacaacaattattatctgtgctttctaggagagaaaactgagtcatggagatattaagcaattttcccaatgtcatgcatctaagaaacaaatcagttaggacttgaatctggacaacgtgtttccccctaagcttaccctataccttcgtaagatatttatgaagagtcatggtaaatgaatggagataataaaattgactgggatgggaagaaggggtaggggtttatctcaaaaactgatcttggaagagaatgataatttcaaacttaaattttaattagtgacagtatataaaagcaaaattatgttatgatgttaaacaaacagctaaaaattgggtgagaataacatgtctctattttagtaattccatttactcagcaaaatgcttatggcacgattctttaatttagtgcagtacagcttgtatgtctagggccactgtgagtcctggagtgcctgggattatctgcgtagattggacatgaaggtttaatggccatgaaacaggcagtattgcttgacgccctaggatttgtatgggagagctgaggtagacgctcaacccccggcagcattctaggtggaaaagaaccactataaaaggaaaaagctggggtcctctcacagactttgctccggaagctgaacagagtgtggtggagaggagctttttgaatgcagcactgagtagtgtgtccctttgtcccctgatgcaggatgagagttcaggtgtctgttaactagttgagctccaggaaactgggaactgagaacagactatagaggaccatcatgttttgaggtcatgtggaattgtctctaacacttgaggaccatttcccaatccagcaagtatctgacatggcagaaaagcacagcaatgtcagtgagtctgtgaggcaagtaacacctgtagcgacagctacagccagaagggatgccatccacctcattagtgtaggacacagatgatcactctctcctccttgcaaaactttcttcacctggctttcaggaccacacacacactattctagttttcttttttacctcactgcctgtccccaagtctttcttgtcccggtaaatagaaactccatttgcttaggccaaatatttagcctacccctgactcttctttctcatacttaccacatacaattcattattaaatcctgtcaactttcccttcaagccatttccagaatatgatcccttctcccacacttcttactatagccacagtgaccatgtcaatcctctgctcaaaactgtcagagctgcatcatctcacagatatggtcctacaagatcagatttcttgtcacctatttgatcttatttcccatcattctctccatttctcactgagctccagctacactggccaccttgctgcccctcacacatactgaaactagtgccaccttaagatctttacatttgtgcccctccccaacttcctggaatatgtggcttgctctctcacctccttcaggtcacagctgaaatgccatctttattagagaaatatgctctgacagtaccatctaaaatagcagccctgccaccatcccctccttgaataactcccaatctccctctcctatttcttattattacctctctatagcacttattgccatctgaacatatttgtttattgtctgccttttcactagaatgtaagctgtaggacagaaaagttttatttgtttcctgagagcctgggcttgttttggcacacagtgaatacaaagtaaatatttactgcatgaattactgacctaaccccatgttgcgtttgtagaaagagaccagcaaaggagaatgagtcttgggaagttaggctaaaagaggccttggaaaggccactgaggaatccaaatgagacacagctgagagaccttaaaaaaacagaaggaattggaattccagtgatttctctgaaaaagagttgctacaaaccagagactgctgctgtttttcaggggcctaggaaatgtggttccagcatgatgagtttaaagtttgacatattttaatcagcttagcaaaggcattcgttttatagaaaaagctggatatatgtgactatatatcttgggtagggggtcaaaatgagcagagagccatcattttgaatcttagggagagcacaaacttcgaggcttacattcacaatacaatcaatggcatccttctgtcccctggtggccacacagctaaactgcatgaagagataaagtctttgaagataaaacaaaacaataatttcaaggtaatatctttcaaagcctgtaccaaccatacatgtgtgtgcagtgcatgtgtgtgtgtgtgtgttttagcataaagatctcccaaggtttctttttcatgaaacatgtccgtgctgccttactctgagttcagcattaaaggggaccagttgaatggaagacattaccctgacagctaccttttgctgtaaaacacaccccccagtccagaccacaaacaagctcctttcatagccatctgccaggtgtgtttgtagaactgatatctgttgaagcttggaggtttgtataggcaaccttaaagtctgggattctacaactttatgatgattctttctcattctatccccttccagtctatgagtctgggcatcccaaattttcccacttcaggctttcacttgttggaagcatctacatcatctttggattcacttctatttgtcccattttagttctgcaaaaccttacaacaagtattcttgaagaaaaaataccagaatagatcctgcacagatgaaaagaattaatttagcattgtatatctgttacatgcaagcttgtatagatttaggtatgtgtaacagatatctaaatgtctgttcaattcttggtttggagttgctagtccatgatattaaaggtgaaaaaggtcctgttcattttatagatgaattaagtgcagtgaaatgcttacttcaagatcacatagccaattggaggtagagccaggactagaatgcaggccttcttacaccttaccaaatgctgctgttggcagcaaagagacaaagctatcagcatcgacgaagctgaccccagtgaacagtgctccctgtggttttagatagttcaacaaacctcgttcagctcagcaaacaagaaactaaacttcatgacatccttagttttgctctgtgcctggctgcctagacctaccaatcatgatttccaggggattccaactccatgatatctcttacattcatcaattttcttccaacttccacagaaattgctgtggttcagacgagtcatctagaagaaaccctgttgcaagttctatacagcacacatgtgccaacacacacacacagagacacacacacacacatgcttgcatgtacacaaacacacacacacacacacacacacactacccataagtatatgtaaagagaacggcgggtattatatcccaagcatgccaaaaacagtaggcccagtgtgtatgactgttgtgcttttttggggggtaagctgtgattcacaatgaattccattttagaatgataattttaagggctggcacaggatctctttagctatatatgtatacattgtatatctgtacatgagagagccacttgctatttttaagaatattgttttctcgcttcttaaaacaaagtattatttttaaattacagaagaaacactatttattaagatttgaaaggtatacatcctataacccagtaatctcacttctaaagtggatacatggacccaaggaagtttgtacaaagatattcatagcagcattgttttgtaagagtggaacagtagaaactacctaaatgttcatcaataggaaaatgaataaactgtgtcctatccatactgtagatacagtatggcagctaaactcaacaaggtgagtctgtatatactgacatgaaaaaaaatccccaaggcatactgttccataaaaagagcagtctgcagaatcatatatattatttacaataaaaaatacattcatttattcatgtaaatgtgcagaaaagcctggaatcttatacatcaaaatgacagtatattttacctcatgggagtacatgggaaggtgggggacaaagagaagacaagatgaagggcaaggggcattttaggcttttgttatatcatgatgttttggctgaaaaacaatatcatgtattgtgtaatttaaattaagtactaaaaattaatatgtaattgtttaactatttcaaatcatataatacataaaataaaaagtgatatttcatctttacttttccataatttatttatcccttccccttttggtggacactttaaagttgttttcattttttaaatttgttattacaaagaaaattcttctttgctttttttctttttctcactcatgttattatttctgtagtatagatctctaatactctggtcatggaacataagcacttaaaaatttgacagatgctgccaaattgccctctagaaagactacgctaatgattcatagaacattagttctgtccatgtaaactccctagtttacattaccaagcttgctacaatagcagttgcacccagacgttctgatggggcctcaagtccagatgatagctggcttcatttccttccctttgtcggttgaccattggtggaaaaagtgcaatgtctgaccagatggcccaatcaatagagggagctggggtagagtgagaggggctactagaagactaaatctgcaggagctatgaaacgccgacaaattaatgacccatgggctacatgtgacccacagacatgtttcttttggcctgtataatgttgggctacagagtgtgtaaaaaaatatgactcagtggtaagcattaaaggaacagtgcttaatccccaacttgtgatgttttctttcaggtcgttctctatgtacagatttatcaattcatataaaacccctgatatttctttatttcctcactccttccatgagaggtaaaatggctcctttttccctttttctttgtagctggttcaccagcagagcacgtttctgccttcaactgggcaataattcaaattctggagtttaacattagaaagactagctgccctgagataagttccattctggaacagaaaggtaatatttttatttgaagctatctttatctttgtctcccaattgattcagaattaaactaggaaagagatgtactattgattggacctccttaaacccaaacaccatgttctaaaatatggaaattttgaaattgagagattgtgcatcataattgatatttctggattttttgaaaaaactggaagattaaccctgagcccttgtttctaaattgtgtgctatccaacttatcacagtccttactattccctattatctgatacctagaatgagagaccactgacattgagcctcatgtgataataaaattgtagtagacagagtaatacaccccccaccatcacaaagatgtccacattctaatcctcagaacctgtcaatatgttcatggcaaaagggattttgcaggtgtgattaagtatagggacaatatctggggtgggcccaatataatcacgaggttcctaataagggaaatatgaaaacaagaggctcagagtcagaaatgatggaagcagaggtcagaaaggaacgggatttgaagatactacactgctacctttgagggtgctagaaggaatcactagccaaggaatttaagtagcctctagaaagtagaaaaggcaagaaaaaggattctctcctagaagctccagaaaggacacatctctgcttataccttgattttagatcagtaagaccattttgaacttctggcttccagaactgtaagtgaataaatttgtgttgttttagaccaccaagtttaagtggcaatcggaaaccaatacaaaagttaaggagaaagtcaaacacttcttatactggtacacctatcacgagagggaaaacaaattagatcaagatggctatacatttcagtaataatgtgagagagtatttctttgttttgttttgtttttaagagacagtgtgtcactctgtcacccaggttgcagtgcagtagtgtcattcactctaacttcaaactcctgactcaagaaatcctactgcttcagcctacctagtagttaggactacaggtgcacaccaccacagccagctaacttttaaaatttttgtagaaaccgtgtctcactatgttgcctagactggtcttgagctcctggccccaagtgatcctcaagtctcagcctcccaaagggctgggattacaggcatgagctaccactcccagcctacattgctgatagtttagccagcatccaacactccccttacctttcattaaaagtactctgatttttgtttaagtatttaatgctctcccatatctttgatatactttagggaaaactaatgcttctctggtctaaatgtgattctatccttgctacaatgaatcattcaggagcccaaatttaagaaagtcaatgaatagaatttccagattaagagattggctcaatattgggtatgtggcttaattttgtttttttttcttcctgtattctttctagctagtgacctaatttttaccagtgcaagtctgtgaaattgtttcctgtttctgtattacaaacaacctcaaaacgtaatggattggcagaagtcaattggaagattcttttgctccacatggtgtaacagagttactaatgtgcctgcatttagctaggagtttggcaggaggtagaaattccaaaggtggctttttattctttggagtccatcttcagatgacttctcttcattcagtagtctaacctgagcttctttacggtatggttaacagattccaaggaggagcattccaagagacaaggatgcaagaacacaaagagaaaaatacaatgtgtaaataaacttttgctttttcatcatatgtctcattggccaaagcaagtcatatgtccaagttcagagtcaatgaagaaagtgactacacaagggcatgaataccaggagaagagatttattgcaggccactatccaccacaggaatgcttagcagaggtttaagggaaagaaattttcttatttttaactattcaaatatattttctttcttcctctattcaatatggtatacgaatgggaagcctggatctgctttagccatttttgcacaatgatgaaaatcaggctaaggataaagtcaactaacagagtaggctaggctaaggataaagtcaacaaacagtgggacacaaatgaagcaatcacagagaaacagaccttaggccacaggattaagtcaacctgaaatatgttttatttctggacttccaaataagttaattaaaagcattctaactatacagcaagtgaattccattactgcatatttaacatgcaaaagatgtctgttgacagagtataacttaaagtgccattatgaaacaaatcataagaactatgatagaaacatggaagtgtttaataataaaaataataaactaaaaaaaaagaactgaaatgtcaacagtgtttgctttggaaagcaaattggtgatgctattaggaagtacagttatttataaagtaaaaaaaaaaaaattgcttgtgcaggaagcccttttagatacagcatatatagagtttgaggtggagtcagaaggccatttagaagcctccatctggccaggcctgatgactcacacctgtaatcccagcactttgggggactgagtggggcagatcacttgaggtcaggagttagagaccagcctggccaacgtggtgaaacactgtctctactaaaaatacaaaaaatagcccagcgtggtggtgcgtgcctgtaatccccactactcaggaggctgaggcaggagaattattgcttgaacctaggaggcagaggttgcagtgagctgagatcgtgccactgtactccagcctgggcaacagagcgagactccatctcaaataataataataataataataataatagtaataatggtggccaggtgtggtggctcacgcctgtaatcccagcactttaggaggccaaggcaggcggatcacctgaggtcagaagttcaagaccagcctggccaacatggtgaaaccttgtctctactaaaaatacaaaaattagcagggcatggtggcaggtgcctataatcacagctacttgggaggctgaggccaaacaccgcatgttctcactcataagtgggagttgaacaatgagaacatatgggcacagggaggggaacatcacacaccggggcctgtcgggaggtagagggatagggtagggatagcattaggagaaatacctaatgtagatgacgggttgatgggtgcagcaaaccacaatggcacatgtatacctatgtaacaaacctgcacattctgcacatgtatcccagaacttaaagtataataaaaaataaaataaatttttaaaaaaatctctggacacatgtttctcttctgacattataggctctgaagtaagaaccacagtcgtcatacaaacctggggagtgttgcgcaggcatttccttcctactcacggctgtgccgtcagtgcattattaatcaaagcttgttcaatcaacactctctcctgccaacctgttcaacacaatctgacatttgctaaatgtgcttcaaagaaaaaagaaggaaaacacatggcaaaatatatgaaaaatatttaacttcactagtaacagtagtaatcagagaaatgcaactatagcaagatacctatcaaattggcaacaatgaaaaagtatagcaataccattttggtaaatatatggagaaatagtaccttctagagggaatgtaaaatgatgcaacaacttcagagggtactttggcattacactgcatttaataaagaatgagatagctatagatgttgatttagcaatatctagctacgtactctagagaaatccatatatgtgcacaagaagacttgtccaaaaatgactagtgcagcatggtcaatagtaataagcaacataaatgtccctctgcaggagaatggatgaatggatgcactggaatattatacctcagttaaaatgaatgacatagagtatatgtatcaacatgactaaatctttaaattacaatgtgcagtaagaaaaacaagttgcagaataatatacaatgcatagtaatacataaaaataatactctttttatgaagtatggcaacataccaaacaataccatacattttttcttggtacctacaaaattgtaatagtaaaaaaacatgcaaaggaatgctaagcatcacattgatggcagtgaacacctctggaaaagagcagctagaaatgaaaattggggcatgaagagatcttcatccggatctgtaatgtttatcttatattttagaaagagaaattaataaaaataaatagggcaaaatgttaacgtttggtgaaactggctggaggattgtttttaaaaaagaacaaaacaaaacctcgaggagtaatctggcctagaaactccttctaggattgacagtgataaattgatccacgttcctcaaatggtggatagttgaaaactgaatttgaaaacgtgctttctgattattttagatacatcatactctatcaccaatgatagagtgaataaagagcaacagataaaatccatgaaatgcagtgttgaaaattaaagatgatgacagcaagcaatcagaatgctagaaatgcctcagaagaagttatcctgggccatttcgcaaatttttattcatgtttggaagtaactacatttgtgaacagctgtttcttcaggacaaaactaagaactgaatagaactatgtaatgctcccagttaaagaaatctaggctaaattctttactgcacatcacaaagagaaataaaagaccttgacattgacatcttgggcctgaagaaaaatgttgttagactcacatgaaaggattagaacattacaaaagcaaaactaaaattttcctgtttctattggtttttaaatttcaaatttaaaacataatttccagtgttgtacaaattattaatactgacatcaaagcttaaaaaataaagctcaattctattcacagcagctgatttttctaataccgtatatgttacctacctgctctctgatggcacacccttccccctgcaatatggcttggctgttctggcatctcactttatctttcattatgtctctacccagggttgtatcaaggagggtagtcagaatggtcctccctgggtataagcaataagagggtgcattgtcctttaaatttaaaggaaatttaaagacaataataaaactaaccaaaagttgatctgcttttaaaatgttttttgtatgaaattatctttatctcaccttcatttttaattgaaatctgtattgataaatagactttatgaaattgtaagaaataatagggagagatcctatgtattcgtttcccagttcctccagtggttaacattttgcaaaactggagcacaatgtcacagccaggatattggcattgataagatttgattttagtcagatttcccagttttacttgtactcatttgtgtgtgtatttagttctacacaattttatgacatctaggtttgtgtatccaccaccacagccaagatactgaacaggtccagcaaaaggattccttgtgttgcccttttataaccataccgaattctctcctgcctcctgatggaggaggttcctctcccttcaccatctctgtcctctgacttccactaatctgttctccattttttaactattgtttaaaaatttttatatagattaaatcatacagtatgcattcttctgagattggcttttttttttttttttgagacaagttctcactctatctttcagactagagtgcagtgtcatgatcacagctcactgcagcctggacctcctggtctcaggcgatcctcctgcctcagccttcgaagtaggtgaggcacaggttcacaccaccacactggccacttttttaatttatttttttggtagagatggggttctgcttatgatgcgcaggctggtctcaaactcctgggttcaagtgatcctcctgccttggcctcccaaagtgctggaattacaggcctgagttgctgcacccagctgagattggcttttctacttagtataattccccagagatttatgctattttttttttttttttttttttgcacgtatcagtaggtttttgtttttgttttgtaatattctatgtatgtaccacagtttgttaagccattcacccaatgaaggatatctgagtggtttctagattattgctattacttataaagctgttatgaacactcatgtctaggttactgatctgattttttatcacctggaaattctgtcatttactggagtagactattcccatcaacctgtttcctgcctagtacatcatgctctctgccacaattgctgctgataccattatcagtactgctgctggtgttagtagtattgaagcttggacagtcttccctggattggagagtggtagagagacgagagggcatctgtagccgcagctctgacattaagaaaacgtgggctaatccttaaccagacccaagtgtttctgcttctctcttcatctgccctcttctccgcctgttaactaatactctgcttattttctaatccaaaattcagagggaactagtttgcttggcttagctaatgtgccagccgccttatgggcttaaaatccgtctatggatgaatcatcactgggtcaggtgctcatgcctaatgcaatatgtactcactcctaaatacagcatctatttccccaagctgaagggcaggattatttgatctgtgggctatgcaatttctgctaacaggaggtattgagtaggccatgactgcaatgtccagcaagcatggaaaattctctaggtaaactagaagcccatcttaatcataaagtaagccaaaaataataaaacacccacaaagtgttgaatttttataataatgttcttcaaaaaatatggttgtaaaataaaccccaagataagaagataaaaaataatctgtaatccagtgaaaagttaggtgatgcgcatcagaaaggaataatctagttttggaaaaactgatttatagcccttctttcttataataaagagatcacaagtttggtttactgataaggttcctctgagtccaacatgataaaatcataataggtaaatgtgttttgtgttcgattgtttataacaattaaaacaaaggcccaaatcattaaggtataatttttaaagtgaccacacaatatatcttactctaatgtaggggttggtaaactctaaccagcctgctacctatttttatatgtaaagttttattggaatacagtcatacccatccatttacttgtcgacagctgcttttacactacagtgacatacttgagtagttgcaaaagcaaagcctcgaatatttactagctggccctttacaaaagaagtttgctttgtttaattaccaataacccattataccaatcctgatcatttttggtggtattctgtatgagcattagctgcaaaagcccatgttaattcatgcaacttaacccatatcaaattcctagcctacaaaattagaggttatagaagggtcagtacatgccacaatctaatcattttcaaagagattttctccataaggccttataagaaataaaaataaattgacagaattttcattaaataatacttcctcatataaaactctgccctgagaaatctagattgaaatatctcaagttaaagctggttgttatggtctaaatgtttgtggctcacccaaagtcatgtcgaaacctaaataccaatgtgatggtgttgggaggtggggcctttggtaggtgattaagttatgagtatggaaccctcatgattgggattagtgcccttacaagagagactccagagagctgccttgctccttccaccttgtgaggacacagctagaagctgtcgtctatgaaggggaagcaggctctcaatagacactgaatctgtcagtgccttgatcttggacttctcaacctccagaactgtgagaaataaattcctattgtttataagccacccagtttatggtattttgttatagaagcccaaacagactaagacaatggcattcatgaaaaatgtatctaaaatgataaagcattcaataaaattaaaaggtatgcatttgccataaagttgaatatttattactagataagcccaggcatcaaattccctgacctagttgggggtagctgtgaaggaactttctgatatggttctcatcttttaaggatcccagaataggggtggttgcccacattttgtctcccatagggtcaatatatatcatactagcagtcctgcaagtgtctgtacaggatactagctttaatcttgagctcctcagaagacatttggggaaaggatattcttcatgaagcaataggggccatttctatctagacctgaattgtcaatacatcatatatatccaagaatgctgtggaatgatattcagtgggaccacagggagaattacagtttgcaactagacaaagtgggctagagtctcctaaactactgatgttaaggcatattgatgatagtcatctaaatcttgtaagagatgaatgtttgagatcttttcggccgggcagggtggctcgcgcttgtaatcccagcattttgagaggccgaggtgggtggatcacttgaggtcaggagttcgagaccatcctggccaacatggcaaaaccccatctctactaaaaatataaaaattagccaggcgttatggcgtgtgcctgtagttccaggtactcgggaggctgaggcagaagaatcacttgaacctgggaggcagaggttgcagtgagccgaaattgcatcactgcactccagcctgggcgacagagcaagactccacctacaaaaataaaaaaataaaaaaatttcataaatatacaaaggttaactttagagaattacttgacattaaatcctctttaaccacaaatatagctccaccttctaggttataaaacaaatgccccttgggtagattctagcacatgaggtgaaatttatttacctcttaatcttttttttttttttttttttttttgagatggagtctggctctgtcacccaggctggagtgcagtggcacgatcttggcccactgcaacctccacctccagtttcaagcgattctcctgcctccgcctgccgagtagcttggactacaggcatgcacgaccacgccaaggtaatttttgtatttttagtagagacagggttttgccatgtaggccaagctggtctcaaacttctggcctcaggtgatccatccacctcagtctcccaaagtgctgggattataggcatgagccaccatgcccggccttaatctttgctttggtatctgctgtaagaatgacttctgccacaaaaagtcacacactttttctcccactttttaaaaaaactgttatcaaaaataggcaactatttttacttaaactttgaaaatataatcctggacgtcttaagattaaagaatgtgatgatgaaagcaggtaacactcaacttggaaagaagagcagaaaagtactttcactagagaaatcgtaatgagaggttgccatcatttaggcagcatgtgggtactttacaaacataaaattagagcgttacaaaaatcctttgaattccctaattttacaaacttaaagtccttaattaaaaacaacaacacaattgcaagttgacaaataagacaaaatcccttgcaaaaaataatcattaaaaactagtagttacagaatatatttttacactgatttttgaaaatgaaattttgtgttaaaatcataaaataaaaagcataaaatagaagctattaattatgttgtaatggtaaatactggatttgggctgctattttaatggtatttattctgcataatatgcataatatatctatgtggtcccatattcatttatcctatttagaattgctttcttttttctttttttttttttttgagacggcatcttgttttgttgcccaggttggagtgcagtggcacgatctcggctcactgcgatctccgcctcccgggttcaagcaattctcctgcctcagcctcctgagtagctgggattagagatgtgtgccaccacgcctggctaatttttgtatttttaagagagatgcggtctcaccgtgttggccaagcttgtctcaaactcctgacctcaaatgatccacctgcctcccaaagtgctgggattacacaggtgtgagccaccacccccagcatttcttctatttagaatttctaagagcaagcagaatgtcatttctctaactattaaatgattatccagaagcaaaagtacagcacaggaagataatatttattatattttaactagaaacagagcagatagcaagttcaccaggtaaaaattttttttcttaaattatgcttaaacaacaataataaaaaacaagtctgcatgtatattttggtcactattatgatcttccagggcacaaaagccagcagcataaagaaacatgaataatgactgagaatttttgatgtgccaaaaacaaagatcactgcattaaactcctttattttgttaatattattcttaaacattgaacaattattaattattgttatttggcaaaatatcaaacatgcacatagtattcctacaagaatattgccttaatattgtcaatattaacgctaagcttattcctctccaaaattcaatgagttatggttccgctctctatatgtattagtgttagtggtaatatgcaaaactgattttgttttcagggttaagtagcagattgacttcgcatttggtggccagctgtgtaccctaatttttcatctattttcttaataaatttaattacatttcataagccctgagataacgtgctaaggattgtatacttttaatctatactttattccactcaatttgaaccccacataataagtcttttaagttatttacagatggttgtaactaaagcaatgacaaaatttactacttgtataggtaagactgataataaggcctttaactaagagttgcatattttatatgcacttttaacttgctaggagcaactcttaaaattacatctataattctgtcagaaagcaataagtgcttttcattttgcttacttccatatgtgtaaccagattcacttttttcctcccttgtaaaacaactactttcttttccttccccaaatattaatacgtcttccaactgaacaattgctaaaaggaacttagcatttgcacagcacattgacaactatggtgcttagcagagacatatgcccataataggcatctgataaatgtttgttccacatggaatgagtgaattgtaaggcagctgtttgagtcatacactgttcatcatatactgcaactaattttatttaactaggaaattcagtttaccagatttaatttaccctcaagtgtaaatccaaaaatttgaaattaaaaaaaattgatttactaatcctcagaaaaagtaaacaagttaatcatagttgttactatactattagttgatagaaaattaaaaaaattattactttccactaaatattaagtacaactgaggggaagaaagtttaaaaaaacttaaaaatgttagctaattctcatcattttctccacatttatccttgcagcttttttgttcatatatttattcctgttaacttctctagctgaaagagaattttattatctgaatggagttccccatcaccttaggtacaaaatattagtgaaaagctggtgtaaatataagattgtattttcatgtcatgccatatttctaaatttattttttgctagcattaaatttttcctatttaaacgatgctgtatagaatatgagctaatctgccaattactatgatattgcttgcttataatattcagtttttgttgatagctttaaagcatattgcacgcttttcatctagcacactagtaaacaactattactctttttggaaaggatacactgacaaattcttaagttaatggctttagcccaacatttttagtcagttaaagaacaatagcaatggcaaaaacgttgacaatacagttcatggtccggttctcccatcttacggtacaggttcctgaaacacaaaaaaaggattttgaaataccagcaaaacataaaaattatcagagaatatatatatatatatacacacacacacacacacacacacatatacacacacacacacacacacacacacacacacacacacatatatatatatatatatacacatacatttttcacatgttttaatatcttatttccttcaacctgttaagttttcacatttcatatcggtctgaaggtatacttgttactaggtacaaagcaatactgttgatagtcttttcagaatttaatcagaattaaataagtacttggttaaaaagtgcagtttgactttgctaaaagttggattttgtgtaaatcagcttaagatctcttaccatcagatgtggtatcccaaaaacaggagctggctgtgtgaaagccatatgcgctcttctggaccactgcacaggtcactgcaaataaagtcacagaatgagggcacttacagacaaaggaaaagagaaccaaggtcaaagtgtgtgagttcagagctctacaagccgaaaacaagacaaaaaacaaacaaacaaacaaaaaacagaaaacaaagcgttcagcaaatagattgaaaaaaaaataaaagactctcatctttatctaccatcatgattttgaccccactggattcagttggttttctgaccattgtcattaccattggtgattgtattgcaggaaaaatatcagtcaaattctgtgctttgtaccatgggcagaattcagacacagaaatgcaggaaatactccactttataaacagttgctgtgtggaattacaggtaaagaggcatgggactaccgaaagaaacacagttgagctaagggggggtctcagtggaaagaaagaactgatggaaatgcaaagggtgatgctaccaaagaaaagtagctcaaactgcctttgagtagtgaaagatcttcatcttttaagtattattatagattatctttgaatgagtaaatcagaagtcctttatacccttttagtatccaacttaaatgtctattgtacatataccttctcaaaattcagagaaaatcacaatgacaaaagcaagtgaactagtgaggaaggatactgatacttaccaatatatttataggcttttcccaacttaaccaggtgtgttaaggattgttccactatgcttgcagtccactggttgatgttgttgtgattataatcttcaccacctaaaaccccatctacacactaaaagggcacagagggcagttaatttagtcagtaaaattgttcaaaaagaacaatttttacacaaattgcagtaaaaatttattcaaaacataaaatatacttatagctcaataaggcatcttagaaaatatacacttggtaaacattgattatgcactgtctctaattgcttaagagttttgaaagagtttccacttgcattatctcactctatgagatactatgggccatataaagataaatatgtcatggcttctgtgtaaataacttaatctagcagagaagctaataaaaaaattcgaatatctataacacaaggaagactaatgataaattatgtcataaaaattatggtggggaaattaaaaggtgctatcaattggttaacaagtagctttgaaacagctgggatttgaactagggctcacatgctagaaacaggatgggactaatttaaaaacataattcttatgtatactaattatattctcattcatactatgtgattgtttagctatgaaacaacaactgattatattctcattcatactatgtgattgtttagctatgaaacaactagcacacttgccactgaaagtaaataaagatgctctagaaagataaagtcaaatatcataatttcccatagtgcttgatttcatccacttctgacacctgattaaaagcactggctctagtatcacaatcctaggttttaaggcctactttgacacctatctgctatgtgacctttagcaagtgacttaaccccttcaaatccctattttcctaatccttatagtaaggataacagcatcatcttatcaggttgttgttaggatgaaatgagacaatgaataccaagtgctcaaacaggactagcacagagttagcatataaataatgttaactactattatcatattgctgctgttatattttatatttgagtgataaagcctggataataaagcactcatttaattcatttttagaatctaacacacacatgcagcttcatttactatcattagactcatttaattcatttttagaatctagcttaataatacacacatacacacacatgcagctttatttactataattagaccacagtaaagatttatgaaggcactaatacaaaatcttaagttggatagtataaaatcttcactaatgataaaatatgaaaagagaaatgaaatattttagcaaggttgacaaaagtaatatggctcaaatttttctcctagaaagctcaataacatgacaaagtaggaagggtagtggcttaaggatcaggggaatagaattttaattctggctttaccattcctaagctggtgacctttggacaaacctattcctctcttgagatcacctttccttaaggataaagtaagagcactcatttttctttcaggttatttagtaggaccactccaagttttgctctaaacagcagaaaacaccatggggtgtgggtgccactgtaaatagccctgctaattactattaattaacatctagcctaattaattacattaacatggaggcccatgagacaatgaggtccttaaacagctctgtattctcagtgctaaactcaggacctgggcacttagcaggtattcaacaaatgttgttgaagcaatattggttttgatatactcgctgggtatcttaaatcaaatacactttagactaaattctaagtcatttgtagctcactttttcttcgacgattttttggggaagcaatttctattactaacactaaagaaaatgtatgcatattactgataaatgggtgtctctgagttcagaaggaaaaacatattagcataggggctcagagcaagaaatcaaaggaaagaaaataagatcaataagaaaataagatcagtaaggaaatcagaaataactgctgaaattatgtaatcatctaggaagtgctaaactgttttaaaatgttgctcattctcaggcatttccaatgtctcaatggaaatgtttcaatggcagaagagggttggttcatgggaagaggaaagatagacatttagctgcaagtaacctgtagcaaagctgagtttctttgcagtctcatatttcatataaaaattcaagagaagcttgttttgactacataatgcatcagagtttgtttttattcaaaaatgttttcagttatattatttatattacttaactccctctcacaaatattcaagaaaaactgatgttctaaaatgcatccagtgacttctagcaccacctagccactgccgagtatgtatttcccagttgaaaaagcatgattcttttaatttgatataatattaaagtaacaggcatatggtttgaaaaatccagtagaacagaaaagcttagaatgaagagtttccttcccaccctttcctttcccatccccagtcccattccccagaggaaactcatcagtgtacaactgtttttatttcttccaagggttacttatgtatctccaaataatgtttatctcactatttcctgatttatgaattataggcaacatccatgtaactcctactatgatagatgaaaatttggttccctcagaccacccgcccccttctctcaatatagtgaaatcacgattttttaacttaaatatatttacactgttagaaacatgtttcttttccactctggatgttttcttcaacgcagaggattgttctttaacattcctggcctcttgtcctgtcagttattcctccccatggaggtggaatgagttacctggttggtgggtgataaccattgttctaacatctcatttgggagtctcccaaatgtgttgaacttgggctttagtttctccttccctctccacccaaaccaatgaaaggcaccagcctgaacaagtgtttctctctgctgactcaaactttctcttggatgactcttcccagggctgaactgaatgggagttagcaaaacaaggtacaatcatcaaactggtttttatcaataataaaggtggtattttgttctctttctaatggctcttttttcttttcatttggttcagaacttaaggaagaaggcactatttaaatggaatcccaaatagcccagcattctttcttttatgttccatcaaccaaggacagtctttcctgacttgccactttgaaaactaagatcactcccttctcattacctccactccctcttccacctcccagtttccctcatttgtgcttttacattgtaaaggtattaaaaacctttgctttctacttttaataattaaatactctcaggctacatagatagaatgcataattctgaagtattcaaatatggcaggattttcaggtgcctgtctattcctctcagaccttgagttaattctagctgtgtaaggccagacctgggtgtcaaaaaatacctttcccacactgtggtctgtatgtgatacctctaaaataatgaacggtcccctgccagaattaattcccaaaggtaatttcttttctatttgcctaaaaggagtttcaaatatttttcttaaaattttgattcactatcatatcaatgcttaaaatatgttaaatgatcattttttccaattatattgggcaaaaaagtgtacatgcccaaaggcagatatttctagggcttttgttatctattttatacaatatacatatatattatacatatactttacattataaaagttgacgtgtgtacatatatatgcgtacatatactttatagcattaacatttaaaataatgtttgctttctggaataaaagttattttatccaaaagacagggcatcaattttaaaccagttttctagactaagaaaatccttaagcatctctttcagaataagcctcaagatgctgatagcacacaacaaaatatagaaggacccctataaagagttagtggataaatatttaaaatcttgttcttggccgggtgtggtggttcacgcctgcaatcccagcactttgggaggccaaggcgggtggatcaccggaggtcaggaattcgaaaccagcctgaccaataaggtgaaaccccgtctctactaaaaatacaaaaattggatgggtgtggtggcgggcgcctgtagacccagctactcgggaggctgagacaggagaattgcttgaacccaggaggtggaggttgcagtgagctgagatcacaccactgttctccagcatgggtgacagagcgagactccatctcaaaaaacaataaaataaaataaaacaaaacaaaatattcttcttttaacagtaaggtttctaagtttgtgctgaaactcaaaatatagcttttaaaaatctccaccagtgcagcaagcttcaagagaaacaaaatgtatgactcacctctttgacaatattgtgggcttcctcagcattgaagccaacctaaagggaaaacaaaaggtaaagctgctttcaacacaggcttacaagtatgacgctacacagaatatcctaggctggcctagacaggtgttaaagtgttaaagggcatcaggtctacagaaggggccaatcttgcccctaaacacttaaaaatactgaatgctttccctacctacctcccgtgaggtctggggcagagcctgcaagtctacatttttttttaaaaaagtgctttatactggtgattctaatgaacatcctagattaagaatcattgtattgtaaaacgtaggaaataagcaagaggtgactatgaggatgttatgtgtcataagaatatagaaatggtttcagctaagtgagagaatgaagtggtccatatgaagagaatgcttagtagactattttcaattttgtttttaacttatgctaggcaaaaatttctaggcaaaaattcctttcccaaattaaagattatgaaaatacttgataactcaagattaatatcactttagtactataaagtggtctgacaacttagtcttttctttggagtccccatcaataacagggagataacaactgacatcatgggtttctggtgagggttgggaaagcctgagtcagtaagcaagggctcgtaatccataaagcacctccttgcctaatcctggcaagcattaccgggagcgggaatggcagtgccaccaggaccccgagactccgagccatgggggctgcagcacccgcgctgaggaagccaagggacggaggcagcagcgggaagacccgttttcgaggcccgcccggtaggagggcggcgcccgtcaccccatgcccactcctcgcacccaagtcaggcctcgtcctcccaaccctgccccgaccccaccgtctgatccgcgcgctcctggccacccctcccaccccgaatctcaggactttggggtggggagaacgggtcgggcggggcggatcccgggcccaggggagaggacccgggctcggaggacgccgcaccccaactcttgggaccgccctcgctgggagaccacccggcaagagccccgcgcagaggaaggcgggagtggggggcgctcccaggtagccaaggggcggtacctcgtcgcagtggcgatggtactcctccatggtagcgccggctctccctggggcggagcgacacgccggtagagcaccgcggccgcgcactggcctccggggaggccccacccccgtttatggcctagggcctttccctacgcaatccccgcctttgtgtcgcagtggcgtcacctggcagcgctgggcgggcttcgggcaacgccaggcgtcacttcaggccacgcactttttcctcgcttcctctgccctttctggaaacaagggatgaatgtaaagaactgggaatggcgccagtgtggatcagatggggtgacctagtggcagttagtctagactccgcactagtggttgagtgcccactgctgtgattacttgcacgtatttgttcattcaccatcatgtggcacataaatgtagttaatttcgtggtaaaccagccactttgatttgtccacttactagctatgttacttggaaaaattcacctcccacagcttcagttttctcatatggaaacttaccatcatacctatttcactactggttgtaaggatctgatgagaagctgtatacacggctcctaaagtagatgcttctcaacaagagaacaatgactacattttaaaataaatgtagtaattttaaattagtaattttaaaataaatgtagtaattttaaattagtaattttaaaataaattactaatttccagatgatcctagacacttcctcaaaacctcacaataagtcagaggagttagttcttccatcactgcttttatcaagatgaaactgaggtatagagaatttaatttgcccaaggtcatacagccagtagggtgtagaaaagggacttgagctcaagtagtctgatagcagagcccaagctcttaaccactgtattactttcctattgctactgtaacaaattaccgtaaatgtagtgccttaaagaaacacagtcctgttctcttacagttctgttaccagtgtagggtgtccaggttcttggctctttgaacaaagaattggacaaaacgcacaaacaaagcaaggaaagaatgaagcaacaaaagcagagatttattgaaaacgaaagtacactctacagggtgggagcgggcagagaagccgctcaagggccgggatccagaatcttctctggtccaaataccccctagagatttcccattggccacttggtgtgcaccccatgtaaatgaagtagtggcccacaatcagaggctgaagttacaaaggccacactcctatgcaaacgtctgattggttgcaagaaagcaaccatcagaggctaaagtgaagttacaaagttgcacttctattcaaacaaagatttggcccataatcagtttgattggttgcagacagcaaccaatcagaggctgaagtgaagttacaaagttccactcctgtgcaaatgtctgattggttgctttttgctctttggttgcaaaaagcaaccaatcagaggtactttaaatttcccatctgccctgcagaaaaggtggggatttgcaaagggaatagcctctggtccttttgttacttaggcatggaaggtatggaaggttagggttttccttttttttttttttttgagacggagtttcactcttgctgcccaggccggagtgcaatggcgcgatctcggctcacccacggcaacctccgcctctcgggttcaagcgattctcctgcctcagccttctgagtagctgagattacaggcatgcaccaccacgcccagctaattttgtatttttagtagagacggggtttctccatgttggtcaggttggtttcgaactcccgacttcatcgacctcaagtgatctgcctgcctcagcctcccaaagtgctgggattacaggcgtgagccactgtgcctggccagggttttcctttcaatttagttctatgaagtaagcgtgaaacagttttaagttccctgcctcctgaccctattctcctgcctcagttctggaggtcagaagtctaaaatgggcccatagagctgcatgccttctggaggctccaagacagactctgtttctttgccttttccagcttctagagattgcctgcattccttggctcatgaccccttcctccaaattcaaagccagtagtatcttttctcctctctcgcttctgcttcaaaggaagtgtgaggcatctctataaacgagagatgtatgactcttgccctcctgtttccctctcaagacccttaacttaatcacatatgccatgtgtcttttgcactctgtatcatattcacagattctcagaattcagatgtggacaaatttgagggggagcattattcagccaaccacaacacttttctattttgctccccagaatcaaagttggaaaccattagtcttctagtccatctcccttattttacaagtaaaactgaagctgagaagataaagtaacttctacagggcacataggtgttaactggactcctgggcttctgaacctcaggctcttattttatgaacttagaaccaaacaaggctgtttacttgatagtatggtgtttgttattggttctcctaagttgtggatcatgcagggttactgcagaaaagtgactgtaattcatagaggaagcacatcctctttcaagaattttttttaccaaagttttcatcctatgagcaactccggcagtctattcatgagaaggattcgtagtgtctttgtgaacatcagttttatttccctaaagaactgtttctatgcctgggtgggttaaaccctgaagttacctaatcttaatactgcaagagctacaccagcacatctcaagtttgtgttatgtgatcattcatgatgcatataaagtgagatgaagaagtgttgttccagttaccattcctgtgtaataaattaccccagaatttagcagcttatttactatattatgctcatggattcgtttagtcagaaatttgaacaaggcacagcagaaataatttgcctctgctctgtgatgtctggggcctcaggtggggagactcaaagactggaggaaattcaatggtggggaccagaatcatctgaagacttgttcattcacatgtctgatatctgggcttggatgaataaaatattagcacttccaactggagcaacaacacatggccccaccgagtggattggcttcttaccatcatggcaaccttagggtagccagatcttttacatggcaactcaaggctccaagcatgagggttccatcgagcatggcagaagatatgtcaccttttatcacctagtgtcacgagttacacagcagcccttctaccatactctaatcattgaaacattcactcagattcaaggggaggggacacataatccacttctcaatgggagaagtgtcaaataatttggggctcatgctttaaaactacaagtgggtttattaactagcatcctgtggttgcaagtaacagaagacccaaataggatgagctgaaataatggcatttatttttttatataaccagactgatatggtttggatctgtccccagcaaatctcatgttgaattgtaatccccagtgttggaggtggagcctggtgggaggtgattggatcatggaggcagatttctcatgatgggtagcaccatcccctcagtgctgttcttgtgagagtaagtgagtgagttattatgagatctggctgcttaaaagtgtgtagcacctccctcctctctctcttcttcctgttctagccatgtaatatgtgcctgcttccccttcaccttccaccatgattgtaagtttcctgaggcctccccagaagcaggagtcactctgcttcctgtgcagcttgcagaaccacgagccaactaagcctctttacttcataaattatccagtctcaggtatttctcattgctgtaaagcaatgagagaatagactaatacacagacatacagaggcagagatattccaggttcgtttagttgctcaacaaattttggggcttctgtgcttttcatctttccatgccaatatcctcagcatgtcagcaacatttagcctcatggtcatacacggctgcattagttctggtatcgctaggaacaaagatatcacgttcagtgactaagatgagcattttctggggttgatcggattttcttaggaaagaaaatctttatttcaagtcctcaggagttttctcctcaggttccagtggccaagattgggccacgtgactccccaccgggcaaaacatatgggacaacaaatgtttgttttttcattctgtatggtgaaaagtgagttctgccagcaagaaaaaaaaaattgatataaagtaaatgttggtaggtcagtcctttccaaacttttccatgctatggcccacatagaggataatacttacatggtacattgaggtaaactggaggggcttggtgggcatctgtatggggcttggtgaaaaaatattttcattactttatataattatatgaaaaaataaaatagaaagggtgttaaaattgaattttttaaagcttccaaataaaacctctttcaatgctttagtgagaccctcaatcttggtttcacccatataatattttatatctggctctacgcattgaacagccataagcaattcctgttaatgagtttttaataattaattttccctaaatatgaataaattatattgtctagaaaggtttgccatagaagcagctgataaaaaacatttggacccactttacaaaccactaaaattatatttaaagacttctgtaatggtagactatgtaattaggaccatctctttcactgataattacaaaggttggacaaaatataatagacatttgctcaagggaattggattttttaacaagatagggaagaattatggatctaagacatagaataatgaaacccagaaagatgagcatggcatttgggataactttttacctcgaggtgagaagatgttaagccttttgcttatgggccaaggggtaaaataatcagactgcatgtcctgccaaggaagatgattctggtaaacagtcttgctttgggttgaaaccccatggattaaaccctgggagtgaaacactcaaacttgatcttgcagactgaatctcagttttaaattacccaaacccctaaaattgaattaaggtgatccggaattgctaatgcctctagccaacttctagaagccaatgtaaattctctctgaaggaagaaaacattatcttaggtctcaaatcagacatatgattttttgcatacatcaagtggacaataaaatataactagacacataacgagacaaaacaacattatcttaaatcaaaagacaatggaaacagcccaatcagggatgaagatgatggagttatcagaaatagactttaaaataactatgcttactatattaaaagagataaaagacagggttgagaatttcatccaataacttgaaattataaaaagtatacaaatggaatttctagaagtagaaaatacagtaaccaattttttaaaaagaacaaagaatcgattctatagtggttcctacaaagctgaagattaagtgaagcttaaaaaattggacagaatagaccggggcgcagtggctcacgcctataatccgagcactttgggaggccaaggggggcagatcatgaggttaggagatcgagaccatcctgactaacatggtgaaatcccgtctctactaaaaatacaaaaaaattagccaggcgtggtggtgggcacctgtagtcccagctactcgggatgctgaggcgggagaatggcttgaacccaggaggcagagcttgcagtgagctgagatcatgccactgcactcaagcctgtgtgacagagtgagactttctctcagaaaaaaaaaaatggacagaataaaatagccagagtaaagcacagagacataaattaatgtaaaatacagaagaaagcatacagacaaaagtaataccatgagaaagtttaacatacatagtgagatttccagaaggagatgagacagaatggacagaaacaatatttaatgaaatattagctgaaggtcttccaaaactgatgaaagaacatattagtcagagtctctgtaggaagcagatgaaactcccaaaatattaattcagggaggatttatttacaatgctgtgtgctgggatggtggatatagcagatctataaggaataggttcaggaatccagtatagcctatcacttttctccatcaatatccatccacttgcccagctacagaggcaaggactatagcaactattctgtgttacttcatcccctctcccttttacctccactgatcatagctaatgtttttgattgcaggtggttgtgtgaccaacttaaatgctataatagatgatgcacctcctctatatgtcaagcagcacattttgtgctctacatctactatatttccagggactctgtgattacagttccaattaatgtcaacaatgtcatggatcaatgtgatgtggtacagctctaagatatgagggactcccttaaatctgacgtggaggtcttctagttttttattattattatttatttattttttagatctagtcctgaatccagactttctagttttttaattcatgttcttcatttcatatttataactcttatattttccctatctgtactttctaaagctataataaagcaccaggtgactccacaatctttataagaaactttgttgctatagagattaagcgctacagccacttgacctccagtgccttgccctctacctgcatcacatcctctgatgataaagtgagtaatcattatgccacatcgtggtcatgaattacatatgccctatttcttcccagtaagaagattatccgtgtgctcctttaagtatatgaacaaccaattctcagaatttcattttgagtatgtgtgtatataaagagatttattttaagatatttaagagtcacttatagtttcctttttttgaactgtttcttcctatccctttcccattttcatacttgttgatttgtgagaactttttataaataacaaattatccttgtgtttgtgatgagttacacattctttctcccagtttttttcctctttttattttgcttaagataattgttgccatacacacttttaaaatatgaatatcattaattttatcaaaaaatacttattctaagtaattggctgacacaattgtagaagcttggcaagtccataatctgatgaggtagaccaaacaggctggaggctcaggaaagggttacagttagaatccagatgcagcccgatacagaacaaggaagtaccaatgttacagataaagtctgaagactatctgctgaagaattcccttttgctctggggaggtcagccttccgttctagtcaggccttcaactgattagataaggctcacccacattatggaaggcaatctgctttactgaaagtctggtgatttaaatgtaaactcaaccaaaacatcctcacagaaacatccacaataatgtttgaccaaatatctgggcattgtggcccagccaagttgacacaaaaaattaaccatcacatgctacttctggtaccagttactgtatcaatcaagttgccaagaagaagcagatggcacactaaagttggcataaattgaagagtgctcatttacaaagatgtgggcaggtgaactaatggcaagtgatagtgaaagaacatggggctaacaacagtgaaattgtcactactcctaagctgtgaagtttgaggggaaagaggattaaacagtcatgttgacaaggccactttaagaggaaaaatgatcttttgtcaagggatataacaagcccgaggtggcctccacaaagggaactcggggaataattatcctgaccctttctccttccctctgatctcttattgctgtttctcattagctgaacccaactggaaactagagggcataggaacgactgtaatccatataggtcagtttcccaaagcacgaaggagtgtggactgtgtatggggagagacaaacagaatacttagcatagatcttaagccacaggtccaagaatccctatgatccccaagcaaaatgaataaaaactgtatttttgcacctcacaataaaatggctgaaaaccaaaggaaagagaaaaattgtaaagtatcactgcctcacccaaaaagacaaattaccttcaaaagtgagacaagaagattcaaatctgacttctcatagaaacagtggaaactcaaagacaatgtatttttaaattgatatccagtaattgtacagatttatggggtgcacagtgacattttgagaaatgcataaagtgtgtcatgatcaaatcaggagatttaggatgtccatcaccttgcacatttatcttctcattgtgttggtgtttgggccgtttttgcattgctataaaaaatacctgggggagcgcagtggctcatgcctgtaatcccagcactttgggaggccaaggtgggccgatcacctgaggtcgggagttcgagaccagcctgaccaacatggagaaaccccgtctctactaaaaaatacaaaattagctgagcatggtgatgcatgcctgtaatcccagctactcgggaggctgaggcaggagaatcgcttgaacctaggaggcggaggttgcaatgagccaagattgtgccattgcactccagcctgggcaacaagagcgaaactctgtcttaaaaaaaaaaagaaagaaagaaagaaagaaaagaaatacctgaggctgaggctgggtaatttataaacaaaagaggttttaattggctcgtagttccagaggctgtacaaggcatgatgctgggatctgcttggtttctggggaagcctcagggagcttttactcatggtggaaggtgaagcaggagcaggcacatcacatgaccagagcagagcaaaatgagagggaggtggcatacacttttaaataaacagatctcatgtgaattcacacactatcctgaggacagcaccaagccatgagagatctgcccccatgatgcaaacattttccaccaggccccatatacaacattggggattacagttcaacatgagatttagagtggacaacatccaaactgtatcattttacccttggcccctcaaagctcatgtttttctcacattgcaaaatacagttatccccgccagtagtcccccaaaagcctcaactcctttcagcatcactcaaaaaagtcccaagttcaaagtctcatctgagacaagacaaatatcttccacctatgagcctgtaaaatcaaaaattagttatttacttccaagatacaatggaagtacaggcattgggtaaacattcctgttccaaaagggagaaatcaaccaaaagaaagatgagccccattcaagtctgaaacaaagcagggcactcattaaatcttaaaactccagaataatctcctttgactccatgtcccacaatccagagcacactgatgcaaggcgtgggttcccaaggccttgggcagctctgctcccatggattttccacactgaagttgcaagctgttaatgggtcttccattctggggtctggaggatggtggtctgcttcccacagctccacaaggcagttccctagtggggactctgtgtggggtctccaatcccacatttcccctcctcactttcctagtacaggttctctgtagggtctctgcccatgcagcaggcttctgcctggattcctaggcttttccatacatcctctgaaatctgggtgaaggctgccaagcctccttaactcttgcactctgcatgcctgcaggcttaacaccacatggcaactgcctaggtttatggcttgcaccctctggagcttgtggcccaagctgtacttaaaaccctttgagccaaagcaggagtttgggcagttgggatgtggggagcagtgtcctgaagctgtgcagggtaatgaggcctccagcctggcccaggaaccattctttcctcctgggtctctgaacctgtgatgggagaggctgcctcaaagatctctgaaatgcctttttttccccattgtcttgactattagcacctggttttcttgtcatgcaaatatctctagaaagtgattgctccattgctgtcttggattcttctcctaaatcttcagggctttctagatataagatcatgtcatcttcagagaggaacaatttgacttcttcttttccaatttggatgccttttgttcctttatcttgcctaattgctctggctaggactttcagtaatatgttgaataggagtggtgaaagtgggcatcctagacaatgtattttgacaccttcaaaacactgaaagaaaatactctgaacttagaatgtctatacagcaaaaaacccttcaaaaataaagacgaaataacaaaaatttaggcaaatataaatgaaattagaaattagttaccagcagtacattccaagaaatacaaaaatttatacttttggcaaaatacaaactaattttagatagaagtttgggtgatgtaggaagaaatgaagagtaattacagggctacatttaatgattatgaactctataaaacaatgataataatatctgtggagtttaaagtatatgccaaattcaaatacaggataacagtagcatataaattgagaggaggctaaattgagttaaagtgttcaaatgtccttttattgttcaagaaatgggtaaggtatcaagtaatattatactttgataaatcaagaatgcatttttgtatagagtaaaatgcacaaaatgaaaaattttttttcagtgtataattaccaagctaacagagtagagaaatagaattttaacaatactcagttaacccaaaagaaggcaaagaaggagagaaaaaaagaacatagtaaaagcgagataaatatgtaaaaataataaaatgatagatttaactccaaatatatctgatttataataaatataagtagatcatacattccacttaaataaccaaggacagaacaaaacacactccacctatatgctgattataaaagtcacataaaaatatcaaggatgcagaaaaatttaaagtaaaaggatgcaaaatgaaacattatttaatgctggcatatatgttttaatagcagataaagtaggttttaaggcaaaagacattactagaggaaaagagacacgtttcataatggtaagagtcaattcactgggtggacaaaagagtccaaagtgttatgcacttaaatatgggaaataaaaatgaatacagttaaaagatgaaaaagataaattcacagttgtatggaagattttaatgctcctctcaatagatgacagaataagctagcaaaaagtacattagaaaagataaaggaaatgtgagcaatatgattaacacattttataattgatgtgtgtagaactctgaatacaacaactgcagaacaattcttttgatgtacaaaaagtactttaagtgaaatatattatcttgcttgaggaatttaatcattacttttatgaataatgattgtaatatggtgatagataatttgtctatttgttttgtagctagcagtccttcaatttcaaaccatagagaaacatatactcccataagaaaacgttccgggaattggaaagtatttattttgcttcaaaacgattcatctttgagaaccagagtttattgatcgagttacaaagtaccattttgggagtgaaaaactttgtggatttgaataagatacttaagatcagttattaatgttgtcactagtaggccatgatataagtgttcatagaactctgtaatttaaaatgcaaactctgcttccctacaggctctgttgtaggcaacttcttctatcattcttttgtttctagtatgtaaggcactgtagtcaagactcacacgtagtactatttcaaagcctttgtaatatctggtcccagtatggcaaaatgagttttatttcatagtacaagccattattacaaaagaaaattgcaaggtaatacatttttttaattaccagaactaattatcaaaaatagaacactaatttttaaattaccttacttaggatgaatatagatctacaatggggcagggaatagaagatataaatggagcgggaagttactgtgctgagatatcctttctttcatttccaaggaattgatcactaatgtagatatttgaggagaaatgtattgacaatgaggattgctatgctgtaatactagtctttggagaattgaaaggaataggattttaacactggctgcaaatcagaagcacaggatgaggtgttaaaaaaatttttgtgctagaccccacccccttgagattctgatttaattgttctggaatcaaaactggcatcagtagtttttcagaagcttccccaggtgggtgattatgacatgtagtcagtcagggttgagaacccttggtgcaaaatcttttcttccccttcagatgtcattacaacaaggtaaattcacttttgctggacaggcttaaacatagttctgctggatgttagaacaatacattctgctacttcttgggaatgtttttgtgtcctatgggtttgtcatttattcattcattcattcaacaaaggtttacttagcactctctattgccaaacattgtgttagagaggtagtccttaaccagggcaggtttttaccattgcccccacctccaccccagggagatttggcaatgcctggagacattttgattgtcataagcagggtgagacctactggcttatagtagttagaggccatggatgctgccaaacttccaacaatgcacatgacagtcccctacagtaagttatttgccataaaatgtcaataatgctgaggttaagaaatcctgtattagaagatgggaatgaacaagaaagattgcccatctctatggagtttatgatctattaggaaaggcagacaatacacaaacactatatatatatcatatatatatatatcacatatatttgtcatatatagatatatatcatatatacatatgatatgtacataatgtgtattatatgacagcaggaacatcgccatcttgggcaagcccttcattctaaagttcacctaataaaaaactgcctaaatccaaagggcatcagcctaatggctaaggtcagcaagaccataaaccacaaataacatctccaaccagaaacattccaaactcctccccgacgagagacatgctagctccgagatcacctccctttggccggaaagatgccagcctcaagataaaccccctccagccggaaagatgtctgtcccaaaataaactcccctcctcccagagacattccaaccctgccataaatcctctccctcacactgaaacattccaagctagtgataagccccctcaccctaaaacaaatatattctcttagtctgtaagagaaagtgctcctgaccaaaattggccagaaacccctctcatattttatctaaagtaaaggtgtctttaactgccaatctgtgtttcatgtttctttcctctttctttaactcttacattatatatatatgtgtgtgtgtatatatatatatgtgtgtgtgtgtgtatacacacacatgacgaggtagctgtaagtgttataaagaagacgtaagaaaagtaagggaatagagagtgactagggtgaggatactatagataaggtgaagagggaagagttctctgagaaaatgacatttagataatcactcaaataatgtaaagaagttagacaagaatttgaaagttacattagaagttagatttgaagtttgacgttacatgagagaggacgatggattttctcagagtgtggggaaggaaataaattagaaaaatatggtaaaatctcaggcaactcaattgcgttttgtggtcataattttaaaatgaaacctatcatagatgttgcagcctctggccatgttcagctcttggaagcatatggagaagagtagggttaacccggattggggcttttccaagtgattttgactgaggaagagagaatcatggccttcaaaggcattttcaggggagtgattggtctgatagcttgtggattctaagctcggtaagtagtgatggacagcgaaaaagtgataggatcattgaactgtaggtcaaaatggtgtcagataattactggggtgaaggttctagaaaaagtgagatggaagcaaagagagtaggggtcagaaagttggatgattgaatatgaagtatatatacatatttttttttgttgttgttgttttttgagacagggtttctctctgtcatccaggctggagtgcagtggtgtgatctcagctcactgcaacctctgcctcccaggttcaagtgattctcctgcctcatcctccagagtagctgggactacaggtgtgcaccacccacccagctaatttttgtatttttagtagagttgggattttgccatgctggctaggctggtcttgaactcctgacctcaagtgatctgcccacttcgccctcccaaagtgctgggattacaagcatgagccactgcatctggatgaacataaaatatttttgaagccaacatctaagcaggagtgaggattcctcttcttcttggtgcctcttttatatcctactgtgggcattgtagccaggagagtggtacaagaagctttgtattatcagctgggggacgttattatcaggttccatgattttgacttgatatctttcctggctttttcatatatggggttgtgagtatgagtgaatagggacaactgagtacaaatcctagagtacagtgccatgataaacatactgggcagggggaaataagcaggcaccaaggaaaaataggaaataagacttttccatataggttgatcccttttctccagacgttcatagattctatatgagacatcttatatcccttcttttttttttgcctcctgcccttgtttctgccatacaattttattatgctttagtatttgttcatgtaaagatgaaattacatttgtgcctcaggcatgctctgcctgcataatcacaataagaatgtttttggctaaggtttggaaaacttagtttttttgtgttttggtccctcttgtgcccaccatttctagtgaaggttgtgattttttaaccatttatttaactaaaaattctactagtgttgtggctaatttatgccccacctcatcctcatattacaatctttaaacaaatatcaaactgagaatatttccttccctcacagagaaaaaatctgttttttatttagtgtctgtcttttagtggaaagaatgctgaccttttgatacagggtacataatctgaccctgttgtttattataatgctttattgcactgaaggggcatatgaactggataagaaaagcacatgtactgcatgaatcagttcagtactgtttcagggaaagaacacatgcaaggagatccatttagttatactcagctcttaatttctgtgatccttctaaaccatgtctcacaaaagatatttcctggtgtttttgaagagctggagtaatgtatttactagcataaaatggcttcattaggtatagccattttgttcatcaaaaatctgcagctttatcacagggaatcattcattgtcaaagtgcatatgctaatgaccttcttcatagtcaaagcacattttaagtatttattcataagccagatgaggacttttaaagtagttaattttaaaacaaagtgacctttgtacagggagggaaaaaacattgaatatgaacaaaatgagcatttgtgtcatggttttacacataatagagtatttgccaagcatcagcaccaatcatgtatacttattcaacccatgatgcagccctggttttcaaaagcataatcaaatataaacatatatagattgacctcagttgacattaagggattgtggatagttttctccttgtaacaatcataattatattctattctccttaggtaaagacatggatgatgtagatgttgaacaaggtgctgaagcaacatgattatacacatttctcattcctagtgggctgtttcaaggtataaaaattagaaataggcactgattgaaacattcaagtctcagttttctccttctaaacacagacgaagacttggagaacaataaaaactgtttacaaagggttttctatccacatggtcttatctccatattactctgagttaatgtttgatagaatgggggtatttggagccaagagatcgtcagtcattatagtgaggacatcaggtcagtgtggtgggattgtatttaaatttgtatgaggccctcactgagggcttttaactaggataatctctcctggagtgatttcggcatttggtttttggctatttctttcaggaattgtcacaaagtgaagaaagctgtaatctttctctgattctttgttggttaaaaaattaacccagctaaactcttgaattgatccaattcattgacttttctccacctaaatctaggctggttgaaaatgtctctcaatgaacagactagggctctgtaactctgtggtctgcatccacagtggggttctcagagcaggaggggaaacctctgatgattctctgatctgttcagctttggttctccaccacagccatttcaaacattttcccactctccacctctctgactccagaacattcctgtcactatcaacatattgcttcccactttagcaagaaactggatccatcatttgagggctcctttaacttcttgtcattgaatgaaagaacacacttgcatgcctagctattatttgcttcccttataacagagtggtaattcttccacaggttctttgacatttgttccttctatcttattcgcagaccatggaatgacatttttcttctttctcctttgcttttaatcccactccttccagtgtttattgtaactgccaaactgcttatcttgtatctcttactcaaatgtaaaccccataagaagcagggaactggtctatcctgctccccattgtatttctagtgcaaagatctatgcgtgattcaataaatgtttttgtttttaaattaatgaatgagagctaagagggttgtatggtgaggcaaactggtattatagaacacaaagtgttttaaagttcaattgcagtggggtgtggtttgtcccatgtgtaatcccagcactttgggaggctgaggcaggtggatcacttgaggccaggagtttgagaccagcctggccaacatggcaaaactccgtctctactaaaaatacaaaaattacatgggtgtggtggcacacacctataatcccagctactcaggaggctgaggcatgagaattgcttgaacctgggaggtggagattgcagtgagccaagatcatgacactgcactccaacctgggcaacacagcgagactctttaaaaaaaaatgttaaaatttttaaaaaataaagttcaattgcaataattttggttttattgaggtcccttatgatggtctatactgataggtagtctttgatcaacaaatcagtggcactattagaagatttatctgtagttgcttgtttatttctaactcaacacagagtctatgtcctcatccagttgtccagtttatggcattcatactatgccctgttacccagagactgctaatgtgtaaatttcacagtaaatacttatcagaaaggtaggcaataacactcaacttgataaggaaaagctgcataagaaaatgttttgatagaattatgcttacttattctatcaaatttaatggtgcattgcataatatatgctaaataccaatgacatggttgaacatagtgtgctttccccactatattagcctgttctcacactgctacaaagaactgtctgagattgggtaatttataaagaaaagaggcttaattgattcacagttcaacatagctggggaggccttaggaaacttataaccgtggtggaatgcacctcctcacagggcagcaggagagagaataagtacaagcaggggaaatgccagacacttataaaaccatcagatctcctgagaacccactcactgtcatgagaacagcatgggggaaccacccccatgatccaatcacttcctacctggtccctcccatgataagtggggattatgggaactaaaattcaagatgagatttgggttgggacacaaccaaaccatatcatttcaccctggcccctcccaaatctcatgtcctcacataacaaaacacaatcatgccttcccaacagtcccccaaagtcttaactcactccagcattaactcaaaagtccaagtccaaagtcttatctgagacaaggcgagttcctttcacctatgagcctgcaaaatcaaaagcaagttagtcacttcctagatacaatggaggtacaggcattaggcaaataaatacacctgttccaaatgggagaaactggccaaaacaaaggggttacagggcccatgcaagtccgaaatccaatagggcagtcattaaaccttaaagttccaaaatgttctcctttgactcgtatctagatcatgctgatgcaagaggtggactcccatggccttgggcaactccacgcctgtggctttgcagggtactaagcctccaccccccaacccccggctgctttcacaggctggcattgagtgtctgtgggttttccaggtgcatggcatgacgtgtcagtggagctaccattctggggtctggaggatgctggctttcttctcacagctccactaggcagtgccccagtggggactctgtgtgggggctctgaccccacatttcccttctgcactgccctagcagaggctctccatgagggctctgcccctgcagcagacttctgcctggacatgcaggtgtttcatacaacctctgaaatctagatggaggttcccaaatctcaattcttttcttctgtgcacccacaagaccaacaccacatagaagctgcaaggcttggggcttgcgccctctgaagcaatggtgtgagctgtaccttggccccttttagccatggctggagtagctgagacacaaggcacctagtaccaaggctgcacagagcaggggggtcctggacctggcccagaaaatgacttttccctcctaggcctccaggcctgtgatgggagggcctgccatgaaggtctctgacatgccctggagacattttcctcattgtcttggtgattaacattgggctcctcattacttatgcaaatttctgcagccagcttgaatttctcctcagaaaatggggttttcttttatatcgcatcagcaggctgcaaatttttaaaacttttatgctctgcttcctcgtgaatgctttgctgcttacgaatttcttccaccagataccctacatcatgtctctctagtttagtttcacagatccctagggcaggggcaaaatgctgccagtctctttagtaaagcatagcaagagttacctttgctccagttctcaagaagttcttcttctccatctcagaccacctcagcctggacttcattgcccatatcactatcagcattctggtcaaaaccattcaacaagtctccaggaagttccaaactttctcacatctttctgtcttctgagccctccaaagtcacttccacatttttgggtatacttaatgcagcactccactccctgcagtactaattgactgtattaatccattctcatgccgctataaagaaatgcccaagactgggtaattaataaagaaaagaagtttaattgactcgcagttccatatagctggggaggtctcaggaaacttacaatcctggcagagggcacttcttccctgggtggaaggagagagaatgagtgcaagcaggggaaatgccagacagcatggtgcaagctgccagtggatccgccatatatgatgcttatatatcatatgacgcttataaaaccatcagatcttgtgagaattcactcactatcatgcgaacagcatgggggaaaccacccccatgatgaaatcacttcccactgagtccctcctatgacacatggggattatgggaactaccattcaagatgatatttgggtggggacacagccaagccatatcacccaccaaaaatacattcagccatttacatataaaatgaaagtgaaagtacaaaaggtcaactccaggaagcaatgccatccactaagtgagaaaacaactatttaaggtctatcatttagaggttatatttcaggttcaaataaaatgaatcattcactcccagctagtatgtatcatgttgtgaatctttcttgaagaggagtaggaggaaaagagcagcataaaatctggttgcatgtcacctttcatcttagtagtctaaaacaaattttggtgttatgtctttgcccaacagactatgacttgcttaaaattttggaacaaaatgaaatgcatgctacttttattttaaataattatttcaataaatgtttgttgatagcctgttatgttctaacactggcctggtctttgaagtaagaggagaaaagataaactgatgcttcaaccgggctgattcttggagaagctgtagatgtgaatgagggtaaggaaggtggaactgccaggaaaaagtaacagaatgcatgaaggcatagaggcatgaaaaagcacgtgtggaaaattacaaatgcttcaatttgtctaaagaagggcatatatggagatataaatttgagaatccttaatatatagggggtagttagatcacccaggaggagtatgcagagagaaaaacaaacacagaggctgacatattaggaaacgctcatatccaagggatgggatgggcagtagaagagtccttaaaagatagataagaacaattatagaagaagtgatcacatgcacacatacacacacacacgcacacacacacagagagagagagagaaacaaaaaaggtaatagagtaggtaaattgcattaatggctaatttttacccctccctatattcattcccgttgtcctgtacattttcagtgctcttctactctgactctaggctcaatcatacggcatactttagccagtgaaatgccaggaaatatgacaaaaacagaggtttgaaaagcagcttgcacaatttgtcctgtactcttatgtctctgccatgagaaggacaaacctgggtaggtcactgcccatagcagaataagttattctcagctgagcccagcctagatcaaacaacccccacctaacccacagacttgttttgtaataataaacgattgtttttcattagtcactgagttttggggtggtttgttatgcagcaatagttgactaatcacagttttcaaaaagagagtgaatgacaaagaaagaaaatgagataaagattgaaaagagcacatttaattgggtaattagaaggattctgcttaccttaattagggcaaatttaatggagcagtgggtttgaaaccacaactgcagaagatttgaagagtgtaaaaatagaataatctactgttttgtggagacagactaaacgcaatgtggagaggtagagggcgataggtagatgggtatgaataaagagaaagtgtgttgtttgaagattgtggagatataagtacatttatatgcttaggagacaaaaccagcaaagagagagtagttgaacaaacagaagaaggaacgacttaggcagagtgatctctgagcaggtagaaggcaatgaacactagggcacagaaaaaggaattagctttgcttagaagaaggggtatttctccactgaactgggaatgtaaaaataaggatgggaatagataaagataagttttcaggaaagaagggagtgggagaagaaaagtgaaatggagttcccatattatggcctctatataaagtacaaagtgatattgggtagggcattctgcaaagtcacattgcaaagagtaagaagaatgataaacattaatagctgttactaagtgaagacagggaagatttactctagtattgaggacatactaaagctgggaatgataaatttgtagtggtaaaaatgcatgcttgtatgatttctctagaaggactttataattcaagtctaagagaagatgggcgattgcagagattctaatttgaaatatttcaggatagtgtgatagaaggcaagagttaataaatatagaaggaacaggtgggcgcggtagctcacgcctgtaatcccaggactttgggaggccgaggcgggtggatcacaaggtcaggagttcgagactagcctgatcaacatggtgaaacctcatctctactaaaaatacaaaaattagccaggtgtgtgctcgcttcggcagcacatatagtaaaattggaacgatacagagaagattagcatgtcccctgtgcaaggatgacatgcaaattcgtgaagtgttccatattttttttacactgttggtgggactgtaaactagttcaaccattgtggaagacagtgtggcgattcctcaaggatctagaactagaaataccatttgaccctgccatcccattactgggtatatacccaaaggattataaatcatgctgctataaagacacatgcacacgtttattgcggcactattcacaatagcaaagacttggaaccaacccaaatgtccaacaatgatagactggattaagaaaatatggcacatatacaccatggaatactatgcagccataaaaaaggatgagttcatgtcctttgtaaggacatggatgaagctggaaaccatcattctcagcaaactatcgcaaggacaaaaaaccaaacaccgcatgttctgactcataggtgggaattgaacagtgagaacacttggacacaggaaggggaacatcacacactggggcctgttgtggtgtggggggaggggggagggaaagcattaggagatatacctaatgtaaatgatgagttaatgggtgcagcacaccaacatggcacatgtatacatatgtaacaaacctgcacgttgtgcacatgtaccctagaactaaaagtataattaaaaaaaaaattagccaggtgtggtggcacgcatctgtaatcccagctactcaggaggctgaggcaggagaatcacttgaacccaggaggtagaggttgcagtgagccaagatcaagccactggactccagcctgtgagaaagagtgagactccatctcaaaaacaaaacaaaacaaaaatccagaaggaacaaatagggaaggacattgtatcaatataactttacagtacattcgtgagcaacagaaaaccttaccatatgtgataggttaaataagaaattatttttctcatacaacaaaaatcctgaagaaggggcttagggtcgtgttttgactccacagtaacatcaatatatcattcttcttcctcatcctttttgcatggcttttatttttgttgttgcaatatagctgctgaacaagggcatcatcccgtatgagttccaggcagaaaggaggaggaaaggatcaaaagctttctcttaatgaagtgttactttgggagggcagttttccattaaatctccccttaacctctttggacaaaagtgtatcacattgcatctcttgttgcaaagaagaccagaacttcaaagctttaatattctagccactataatagagggaggcccaggaagaggggtttgatgttggagttaagtgagccaatgattagtgtctatcatataagtgagaccaacaggagctgacatgttgcaaaaaataaaggaaccaaggatagaaactaaataaatttgaaaatcagatgtgatgagacatgcgaggaggctaacagatgttggagattataatttctggtgtgaagcaatttaggcaagaagaaatggttgttgaagagtcatagggtttaagtttcttggaattcagaaggtcaagaaaacatcaaactagaaaggatcttccatatggatattgacatttcttaagatgatagagggacttgcggttttagtaaagtaaaaagttagtctataataaaccatatcctcttctgaagattacatcagaatgaaaacatgtcctgttgcacattcttaaaccccaaaagaaattagaatgacttaaatcgggcagcagttcccagagaaagttaatattcactgacatatcaattaccgatttctttgtaataaaccaattcaaaatgtaatgacttaaagcaacaaccatctataatttttcagaagtctgttggttatctgggtgattggagtcttgctaatttcggctgcactcagctgattttggcttggctcattcacatatctatgttcagctggtgagtcagctggtggctggctggtctaggttagcctcagctgggatgactaagctctgctcctcctgctctatcatctttcaccaggctagcctagacttatacaaaggaaagaatccaagagataaagcagaagtaagcaagatttcttgccacctaggctcagaattggaacaacattacttcttttgcattttgggcaaagcaattcataaggtggttagattcacaaggtggttagattcctcttggtgggaggaatctatcacattgtttattttcttgagtcattattgtaattcatggccatagaaagtctgactattatatatacttcacgaaaataagcataaatgtttagagcttgactaagtggcttcttttagattagtcagattggattatttgaaatgtcagtggtaacagtgataaacatggatagacatacctcatttagaattttgtatagttttttttctttttcaggttgaattgctaaccctagtagctactatgcatattgagctcttgacacctgtttaataataattttttcatcatctcccaagccatgtaataaagtacaaactcatcattacattgtttggctaccatgtgcctgatttatcaggcaaatttttagaacactggtgaagctcgagcacacagtaatagcttcctactatttccatgagaacgataaaagagagagaaaaaattttttgtaaatccaacgatccttcacatgtctgaaacaaacaacatcaagcctgtttttctcaaagctgtgcctaccaaatgttcccctgactgtgtttgccccaatccagagcacacacacatccaactatgtccacatggctcatcctctccctgcttctttttgcctttcctcttacccaccctccaagttagctctatatgaatgtgggtttggaagagaaagaaagcagaacactcagcctgttttctctggatgaatgagtttcacaaacaatgacactccccaatgccacaaagaagctgttaccaggtgtgggacctgaggagaaatacaactcccgtaccagttgttctttgatgcaccacttcaggagccatgaaacagaggaaatttaagatcaatcatagctcttcacacagttccataaaacattttttcccttgaaagtcactttacttctaatgatacttaccatgccagtgtgttaaaactgtcactgaatcaagctttttattaagttgtcagtgtatccagtgtttcacagaacctctgtgggggactttcttgtcttttaaacctacacatctttgccacataggctttcctccataattagcactgacaggttctctttagaggaaatatcccactctcagagtacaagaggtagcaggtgggtggaaatagatttgaatcatttatgagacagggaaagggaaaccaacagttttcatggcatatggctgtgaagagaatattgaacgaatgggttctggacaagtgaagtcatacaagtcaacagtgaattgaagtaataacacaggttacttattccaagagagctgcaacattttggagtgagattttccccaattcaggatcacattgctgagtacataaccttagtctacatttctgtggtctgagactattctgggaaccataatattaccctgtggccacccatctatggaagtcttggcaagtcagagcctcttggtgtctgggtggtttctataggatatcttcttccttggctctactgatttttatggcactaaactctgaacacccattcagtttcctgtccctttccccatcctaataggctcaaatttttaggaaaccatgagtctaccctcatatcactagaaattcattcacttagcttaaggtaaaattcaaattcactgaatgtcctttgacataagccaggtacatatttggtggttttagtagagccagcccagaaggttcccatctatgtggcatgatctgagatggtagactttgcctacaacatccagatatttgtaattcatgtgaacagcttgccagggaatccaaagttcctactactggagtaaatgatccttttcgccagatctaatctgtttctttttcttttcttttcttttctttttttttttgagatggaatttcactcttgtcacccaggctgttgtgcaatggcgctatctcggctcactgcaacctccgcctccaggttccagtgattctcctgtctcagcctcctgagtagctgggattacatacagacttccgccaccacgctcggctaatttttgtatttttagtagagacggggttttgccatgttgaacaggctggtctccaaactcctgatctcgggttatctacccgcctcggcctcccaaagtgttgggattacaggcatgagccactgcgcccagccctaagtttcaaatttaaaaattcacttaaaatttccatttaaattcaatatggtatagaaacataatattataagttaagatagcatgctgtggacttcttatttcagcgctaacatgtaaagagcttggaaagttgtcactcccatccttatgacaggaaaaggtgaactaaaaatcaatgattttttcttggacccatcagagaactgaagtacagggcaaaccatcaccctgaaatctggagagatgggtgaattaagagagtcacagatgaggtctgttaaccaggagcagaagcagctagagccataaaacggtaggaatacttaaatggcaataataagaaattgctagaggtagagcgtggactaaaatgaaaggaagaaacttctgggatgcagtcttatggcgggggggtgggatccatattttcttgagatttacctccaggatccccaccacatacttatgggaaaaaaattgagcatgatctcctggtggctctggtagggtaaaaggaagagcaaccatcttgaaatatgcccagggtattgtatatgacaaaggcctaatctccaggggaaaagacttttaaccaggatcttattccaagttaaggaagggcatttttcctactccattcccttctagcatttctctctcacaagaggagaaaaataaagccaggaaacactggtgatggtcacagcacaaaggtacaggcctattaaaagattaagatttcatcataagtttgtagaatgctttccctccccagtaccttaccaccacaccaataggagtctagtaaaatggcagtggattttagctgaaatagcagcaagatgcagactctttgaggagtattagggaagcccaaagtcaacaggggaggcaaaaacaaaaacactagaggaatttgaagcctcagacacctatagctacagcaaacattaaacacagaccaacttctagccaggttaacgtgaacatttacattaaaggcctatttgacataatttctattttctgatacattatgtctggcttttaacaaaaaaatcaagccattctaaaaggcaataaaaatcacagaatgtagaaacaaaacaaacatcagatccagatctggttctgacaaagattttagaattatcagacagtggatttaaaataactataattaatatgttatgggttctaatagattaaaaaaatagataaaaacagacaacactcaagaacggttgcataatttaagtagagaagtgggaactcttagaaagaattttaaaaatgctagagatcaaaaccactgtaatagaaatttaaaaatgcctttgatgatctcattagtatactggacatggccaagaaaagaatcagtgagctggaagatattgaaatttcccaaaatgaaatgcagagatataatgctatctgaaaaccttcaataacatatcaaatagtaattttatcataattatacccatcaaacagttaaaacatgttttaggaagaaatatgagattgcataggggccatgtctttcaacagaaaaactatattggtccataaaatgtttcagtaagttgattacttataatcaattatttctgaaataggaggagggttcttagcaaaagcattaggtagtgtcttatttcagagaactggaattattgttatcagcttctgtatattgctttagccgttttagcagagaataaataacaatggctttaacgagaaggaagatttgtttctttttttttggagatgggtgtctcgctctgtcgcccaggctggagtgcagtggcgagatctctgctcactgcaagctccgcctcccgggttcacgccattctcctgcctcagcctcccgagtacctgggaccacaggggcctgccaccacaccctgctaattttttgtattttcagtagagatggggtttcaccatgttagccaggatggtctcgatctcctgacctcgtgatccgcccgcctcagcctcccaaagtgctaagattacaggcgtgagccactgcgcccggccaattttttatatttttagcagagacagggtttcaccatgttagccaggatggtctcgatctcctgatctcgtgatccgcccgccttgccctcccaaattgctgggattacaggcttgagccatggcaccgggcccgatttgtttctcttttatatgaatgtccaagctgctaagtaggacaaaaggataaagaagctctggtccataaagtcactaagagattttcatttcgttcttcttgttgctctgacatcctctacgatgtttttcttatcctcaaagtcaaaggtgactcagcatcatcatatctgttttaacccatgtagaaaaaaggagaaaaataagtagaggtcactcatcttccttttaagaaagtgacccaagagttgcacagaccacttctgttcacattgctttgaccagaatgtggttgccacacctaactgcaaggggtctggaaaaagtggcctttagctgtgtgcctagctacccagttttaaaatggagatttcttgtactaaaaaggaaaggaaggaaggaaggaaggaaggaaggaaggaaggaaggaaggaagggagggagggagggagggagggagggagagagggaggcaggcagggagggaaaaggaaaaaaaaaagaaaaaggagaaaagaaaagaaagaaaaagtgagtattagggacaattagcagtctgtgccacagtgtaccttctgaacacccaagtatccatgaataccactttcctccagaatacaatcaaaacagcaaagcagttactttttccagctcaaaacatagcatctaatatgccactggaggggtaagacacagatttcattcacaggtgtaccagagttgacttgcagcagcttgtaccagttcacaagaaacgtttgttaaaaagtttcaattttgtgatccagttgttaaacacaatcattactaaaaattaatttgtatataatgtatcattaaacaaattatattaaaaataaggtaaatattcaaaactcatcttttgaaaattattttactatgttttactattgccaggcagacctgtgctttgctttgttgaactttgcagatatgtttttcacaaattgaaggtttgtgacaatcctgtgttgaccaagtctgctagcaccatttctccaacagcttgtgctcactttatgtctctgtgtcacattttggcaattctcacagtatttcaaacttttcattattattatattcattatggtgatctgtaatcagtgatctttgatggtactattgtcattgtttaggggtgccatgaaccatgctcatataaaatagcgaacataattaataaatgtgcgtgtgttctgactgctccaccaactggccattcccctgtctctctccccgtccttggggcctccctactccctgagacccaacaatattgaaattaggccaattaataaccctacaatggcctctaaatttttaaatgaaagaaggagtcacatgtccctcacttaaaatcaaaagctaaaaatgattaagcttagtgaggaagtcatgtcaaaaactgagacaggctaaaagcgaggtctcttgtgtcagtcaagttgtgaatgcaaaagaaaaattcttgaaagaaattaaaagtgctactcctgtgaacatgcaaatgataggaagatacggagaaagttttagtggacagacaatcaaaccagccataacatttccataagtcaaagcctgattcagaacaaggttctaactcaaattctatgaaggctgagagaggaaaggaagctgcagaagaaaagtttgaagttggttggctcatggggtttaaggaaagaagctgtctccataacataaaagtgcaaggtgaagcagcaagtgatgatgtagaagctgaagcaagttatccagaagatccagctaagatcattgataaaagttaatacactaaacagtagattttcaatgtaggtaaaacagccttctattggagaaacatgtcatctaggactttcatagctagagaggagaaataaatgtctggcttcaaagcttcaaaggacagactgtattgttaggggtttaatgcagctgctgactttaagttgaagccaaagttcttttaccattccaacaatcccagggcccataagaattatgtaaaattgactctgcctgtgctctataaatggaacaacaaagtctggatgacaggacatctgtttacagctattttactgatatgtactaatattagtttactaattattagtttgctaattattttaagcccactattgagacctcctgcttaggaaaaaaaatatacctttcaaaatattactgctcgctgctcatagacaatccatctggtcacccaagagctctgatggagatgtacaagaagattaatgttgttttcacgcctgttaacacaacatccattctgcagcccatgaattgactttcaggtcttattatttaaaaaatatatttcagtaaggctatagctgccatacatagtaagtcctctgatagatctgggcaaagtaaatcaaaaactttctggaaaagatttaccattttagatgctattaaggacattcatgatttattggaggaggtcaaaacatcaacattgacagaagtttgagagaagttgattctaacccttatggatgactttgatgggctcatgacttcaattgaggaagcaactacagatgtggtggaaatagcaagagaactagatttataagtgaagcctgagaatgttactgaattgttgcaatctcatgataaaattttaacagatcatggttgcttcttatggatgagcaaaaagtgtggtttcttgagatggattctagtcctggtgaagatgctgtgagcattgttgaaataataacaaagtatttaaaacattacataaacttagttgatagagcagcagcagagtttgagaggattgactccaattttgaaagagttctgctgcaagtaaaatgttatcaaacagcaacatactacagagaaatctttcatgaaagggagagtcagtcaaagcaacaagctctattgttgtcttatttaaagaaattgccatagccactccagccttcagcagccaccaccctgatcagtcagtagctactggtagaggcaaaagcctctaccagcaaaaagattatgacctgctaaaggctcagatgatcgtaagcatttttagcaataaagtgttttaaattacagtacatgcattgttttttaaagacatggcaccattgaacactcactagactacaatgtagtgtaaacataacttttatgtgagctgggaaacaaacttatttgtatgactcactttattgtgataaccattttattgcagttgtctggaattgaacatgcaatatttttgagatatgcttgtatctaggctattgaggttatttgcatctatatcatctatatgatgggaatactatctaatgatgtggaaatctcttcccaactttgcattgtagcttgaaattacacatgatgggaatatttacaccacagagatcaacacttgctacaaattagctcccacttccccagctgaaaagctagttgttaaacatttaacagcacgccattgtttccattatatctctttgactagaatttacccacatggccgcacctatctgcaaaggaggctaggatatgtagactcaagctgagtggccatctaaaatttgggaattctgtcagcaggaagagagagagaatatatgttggcggatgattagcactcatattttaatgtagaagagcaagatccggataagtttctatacctgggatccactcttgtcactagttcgtctttctggggagggcaggtatctagtcagccatcttgaaccaaaattttgtcataggttcattagcagagattataataaactcaagatagagattttagtacctgtctagtccattatcacagggttagtgaaaattcaagatttcaatttatgatagtagattaatcccatgaagcaagcttttttgtcttatgcccagtttctagaaaatgtaaaaaataattataaatatataaataaatctataaacatgctggcaaacaggaaaatgagcccattgtaacccagaaactatgaagaatcactgaggggaagaaaggtgagataggattcaattacgtacctaaaacccaaaatgtgcctaggtgaatgcgagctttgaaaagtgggagccacacacagagagctccatacctggctctgctttcaggaagattcagatgaagacattggatatatacaagtataaaaggaagtccgtacttttgatttgctaaggaactggaatatgggggtacctagccccgggctcctccttccttccttagtgaagttcctataaaggttcatcttgttttaaacttttaagcctgtgagtattttcttttcaaacgatatagcaagctctacaatttagtgctcaatagaagctcctaggttagaagagatatgaccggtgactgaatgcaatgtttgtgtgtttgtttacaaagcaaacatccacacaagctgtttgctttttctacattaaagtataataaggatatttggaccacataatatggtcagagacttgtcttatgcatatatgacttatgttaaatgagcattatacccaaatattttatctttcaaaatcacgttagaactgagaacaaaaatccaggagtaaaactattaatattcccaggatgatggatgttgaagtacatacttcttcctcaccaaaaaaaaaaaaaaaaaaaggcgagtatctatttttagcagtattttccctcaggagatcagaaaagccattacagagttatggatgaattcttggttcaataataagaatgactaatgcttctacggatttaacagagctggaaaaggctcttcagataaacaacattttagaatgttggaaatttgcattttggaaggaaggaaaatgaaattataattttatttttaaatgatttatctgtttctcatttttggatcattagacacatatcttgaaataatagtaattcagcacttactataagtaaagtgccactaagccctaaaataaacacaatgatgccctcaaggggcttgcaatttagagagaaataagaaaaagatatcttagctcaactttttaaaaaaatgttgaggccaagtacatattgactgtttcatctttaaagcaggttctgtctttctcaacaagttgggaatgcccatgctgtgagatttgtaatattaggtaagatatctgtaattcctcaatttattcactagttagaatatagcctgtgtatcttagtttagagaggaatataaatcctttataacaagtccacctttaccctaaaggggatgaattaggagaagaggaagagaggacaggactgagctgataaattttcacaagtgccttgaaagtctgtttttagctataacgataattgattttagtaatgtgtacacattcccagcattttgccctttttcaccttttgagaatccttggttgttggattactgatgctaggttattaagtgaagagaattagagaaagtgaaaacactaagttgatttacatatgaaagggtatagagttactcccagaatagaaaaatctagaaaggctggagatctatgtgagagagtcatctgggagattaatgagagaaaggagaaagattgagagatgctaccataaatgaatgggcagagtgatacctaaaagcgtaatttctagaagctttgctccctgttgaagtatagatcttctttactgctctgtgaaagactttaggatattctgtaattccttggtatctgagagggattgattggttgtgttactggaaagaggtcccaatccagacttcaggagagggttttggatcttatgcaagaaagaattcagggtgagtccacagagtaaagtgaaagaaagtttactaagaaagtaaaggaaggctgagcgcaatggctcacacctgtaatcccagcactttgggaggccaaggcaggcagatcacttgaggtcaggagttcaagaccagcctggccaacatggtgaaaccccgtcactactaaaaatacaaaaattagccgggcttggtggcatgcacgcctgtaatcccagctacttgggaggctgaggcatgagaatcgcttgaacccaggaggcggaggctgcagtgagccgagatcatgccactggactgcaacctgggcaacagaacaagactccatcaaaaacaaaaagaaaaaaagaaagaaaataaagggataaaagaatggctagtccatagatggagcagggcgttcccaaaagcaagaggaggaaaatgcccacgttaggtacaatgcttgattatatataagataaagcaaaaaatcatgggggagatgtgctgtactacaagggcttgtaacaaaggtttgttaatgtttatgtaaatactgtcttctgcaagaatatatattattatctttaaagttaaacttaaactaagaatgcttttgtttttaagatatcaggacatcagaacatttcctgggtctgatatttcctaggtctattaaatcctggctctattcagtaaacaatattaacttttttccttaactgtaaacatcctgtgactaagaatgcctaacctcctgggaatgcagcccagcaggtctcaacctcattttacccggcctctattcaagatgggctcctctggttcaaacacctctgacgtatttccccccttccttttacaaggggacccttcattctaaggagctttttttcaggctgaatagaggcaatgatattcctgccttaactattaggatctcttgtattcatggtagagaggaattcagtcagaaagtatcagtatggtgagggccatttatataactctgggtcccaacaaaaagtgatatttatttctcttgtttcttcggagtagcagccagagatcactggttggttcacaggaataagcagggtcagtctaaattccagaaaaaactcaaatacaatggatctaaaaacaagtgttccatagttatttaaaaatatattctttttctctccagtcccaatttttattaaaaacaaatcatggtaagattgatttgtttgcaaaataagctttagtattattatattcagcctgattatttgcataaagtgcaacaagaatgattatttgccatgtaggctctttttaaaaattggctttattggaatctcaggttaaactttttaaagccttgagcccagccatgggtttatctgttcctgaacatacctgtacaagttgggtgaattcctctcctttcaaagtcccaagataacttgggcctcctgggcctgtcagggacctgtacagggactgtgtagaaaaggtatgatgccagttttcccaaggggcttttatcagcctatgagtcaaatttgattccttaaagcagtctatttatatctgaaagcacaccattccagtcaaagccttggtaaaataacaagtgtctccaattgtgtcctgttataaaagaaaacagattcttattgcaattcttatgcaaataactatattgccataaattaacaatgctcacagatagtttctaaattctggagaaatttggtagagagaaagaaatatgctccaaattttgtttatagaagtgtgctttactcaattgttaaaagctgtaaatagctcaaaagaaaagtctccttgattctgaaatgaaccagaaagtttgtcaaatatcaaaggtttaaaacacttgatattataaaatagaatctcaggtcaccataagtcatttattagccaaaatgataaagattttaaaaacgcaaaaacctttacttactgataaagggaagacttagctttccaaacaatctttctttttttctctcttcttttaacaacaatttttcattatctcttaatattacatgaaaatcttgttcaagagagaaagccaaatttcaactttgtattagtgtactattaatgtcaaacctaattcttaataaaaccttatagacaaatctatccaatcttaatctgtttgacaataaggtaatattttcagaaaactttcataaccctttacaatgttctgcaaaaaagcacatcagtgtgctaagaaaaccctgctgtgcttttattccaatgttcaagttatggggaaactaaataatatccctttagctttagccaatatgttcacacacagaatttcttttacaagattaacctttcaaaaacgttccacaacatactcaaacctttggctttttcctatttaaattaaaacaatcctttaaccctctaagctaggcaaaaatcatgctcccgtgccttcttatactcttttaccaaaaacacattctactttccttataaacattgcacatgaaactgtttcaccagtagtctcaattacatatgttacaatgttaacttttagcaacttttatttttggtaaaaaaaaaatcctggtaagtaggtgattttaattatgtatcaagtgtggagcttaggacaccagacagaagtgcagataaggtttgattctttccagcatagcaagggggcatggctaactctacatgtcccaaggccttacctagaatctaatggctctaaagcaggtaagttgaacaattatcaaaagtcaaagaaccagactgtgtagtttagtaaacacagtatccgagcggcctaatttagattttcaaaacatttttatgttaccaataatctttaaaattatctttatttcccaaagattactaaagccatgtgaactaaaaggcattaaagtttcttttttctggaaagatatttaaatgcttattacttttaagccaattaatcagagctttcatttattttggtagcaagatatcagacacatacaacacataaatacacagatggacaggcagggcagatttgatagttaaagatttttcatttgctagattttaagtttttctttcacatttttatgccaaattctgggtcattaaaaagagggaaatgctataggaccagacagtgcaatgcttttaccacaaattttactgcaaggacatttccctgaagctgatgggcaatccaaaaccaatcagcccatctcctgtgagagttttaaattttgagggagggggtggtggtggacattttcatattttgcaggtggctaaaaccatgcttctctgattcaaacatgcaagtagtggactatttctcccccataactgccattagccatccccaaaagtgtatttcttatctagttattacaagccaaggttaaaagctctttaataatgcaaagtaatttttgatatccccaaaagtcaaaaagtcaggtaatgcagtgcaaaatggaggacagccttagatttttacagggatctattcacttacaattcctggggctttatgaggaaaacagaggtttctctcaaaaaagggtctgtggtgccttatctgtatttttccaaggagtgccaggctgtcaaaaatcattttaggccctttcatttgggcattgagggcaagaaaacagactggggaaataattcagtcaattgatgagaacaaaacaaaaaacattttatcaaacaaacaagacccaagaagagaaaaagcataaaggtcttttaagtaagtttacagataggtcgtatgcttttaattaagctgatttttagccaaatctcttttaacagactctagccaggacaaacagccaatatttctgggttttgaattttaccaaaggtaacctcccaggtgaaaccagtaagccttaactaagggtatgacttaaccatgaacacacaaggtgtcttcaaagaaatggcaagcagttttacaagttttagagtatccaaagtatcagagaaaagaaaatttgagacaggaagtcagaagttgttcatggaggggtaaataatcagtaaatggcaaaggtcacacaaacataaaaccagaagggactcattacctaagctgggaattgaacatgagctaccattgtaaagagataaagccttagctactgggctatagcatggagcagtctcaggtgctcttcccagaaggagcctagagcagccaattttgagttttcaaatgcttttaactactcatgataatttttagggctaactatgacatgaacctcaaaattcccacaccccagatggtggataccaagagaaagtacccccaaatggtcacaaggttaagctcccaaggacataaaacaagacaaggggtaaacctcatctagttcttgcttcaggtatctgtagcaaactttatacctgaccagtttgttaagccagcttgaatagtgggcttaaaggggtcctaggcccacattttattctatggtacccctttttatgacagaatgacacagaaaggcaaattcatagcacaaaatacactcgattcactatagcctaagactagcctcacaaatcctttttccagttaatcaaaaccttgcagaggagacaaatagtgatttttaccgtttattcaactggtttacacagaaagagagagaccagaatcctgactgctaagaaattcttactcttttgctggcatgccaggtttctggacttcctttctctgggtggtttgatggccctgcttactgtgccatagctttgtgggccaagacacattacaaaagaaaatcatgtttttccaactttgcaagatgctgcccaatgagctgcatgtgggagccaaattaacattttgcactctggctggggcaaagtacatgtgacaaaacatagactttagccatcccactcagcacctaatatcaacctggcatggctcaaatttgccctcattggcccttgttgtctttgatccactcaaagtggggtggaatgttgaaaccaggagtttcaacacagggtctctaggcaagatggaagaacagacagtcgccctgagtgatagaaaagataggaaagggaaaagagagaaagataacaagaaaaacattgcttacagcagagtgggggaaagtgaggagctcagggaaaccagaaaaagactcacccattgcggcgacactgaatcaaaagttcaggcggttgcttgtcagtcacgaagggatctttagcatcaatcctattagctctcaagtttcccactttgggggagaaagaaaagttccccatgtcccataattttgcacgtgcctaatcctgtcacccacaaccatgagataccaaatttcaatagacaatcttagggattgagctttaaaatgaaactaaattcttcagtgcctttttgtccccagtgtttctcagctttgtgacggagccaacaagcaaacagatggaaatcaggtggtgcatggggtaagggaaagttaaaattcccagaaccaattaagcgaggtctcctgaaagtggcagtgagccaccgcaccaggccacactggagtagattttgaagtctgaaacctagaacttgtcaaataaaccgccctaataaaaacacccctgtcaacaaagggcagttctaaggcttgaagtcagatctgaccctcgaagttgacactccagcctctttgactctcaggtctttgaaagaaaagggaaaggtccatcatgactttattccagagtgaatttctttagttttcagaagccactttaccataaatagatgtgccttgggggccgggcacagtggctcacgcttgtaatcccagcactttgggaggccgaggcgggcagatcacgaggtcaggaaatcgagaccatcctggctaacacgaagaaaccccatctctactaaaaatacaaaaaattagccgggtgtggtggcgggcgtctgtagtcccagctacttgggaggctgaggcaagagaacggcgtgaacccgggaggcggagcttgcagtgagccgagatagcgccactgcactccagcctgggtgacagagcgagactccatctcaaaataaataaataaaataaaataattagccaggcgaggtggcgggcacctgtagtcccagctactcgggaggctgaggcaggagaatggcgtgaacccgggaggcgcagcttgcggtgagccgagattgcgccactgcactccagcctgggcaacagagtgagactctgtctcaaaaaaaaaaaaaaaaaagatatgacttgggaagtgaaattctctaatctgaaactttattgcaaaaattgtgggcatctaggagaactggagttgtgagcaggtcagaagagaaactttgctgcttcctttgtcaatgctgtatggagagaaatttgagatgctttggatattaaaagaaagactggaaggcagaagatactgaattaaccacaccaatgaagagcggtaagcagaccatgcgagtagcaagactatttctgcagagttcataacaggagctgtaagtgacccagagaatactcactgtggaaagttgagatatcattaggctctatgagacttcaggttgtagcattttacttgttgcaaattatgtagtggaattatacttctttatcataaaaatctcttgcgtcgtggtgtggccagggctctttcatatatgggagttggtatcagtctactaaacagtccagtggagacagctctttttgtttcctattgaagtctcatactaaaaaataaaagctgactattttactacaaatatcattaatcctaaagatagttttagatggtacacaggttttaatgtttttacaataaggtcatatgaagccaaaataactcctggatgtgggatgggcttgagtgggggggataatcatacaaagagtttttattagatacattgaaaagcaaagtaaaatttacctaataatagcccacccagtggaaaataattgctttaacttctcttggatattttaatctcaattctgacaaaatgaaggcctcttggcaatttaacagttctttggcttttagctgaaagaaaataaaaaaaaaaaggaagtgccactaatgcttgagataaatactaagtcttacaggactggagttaagttgttttccaaacagataaaaacatatcacaattatgcttcatttaggttttattccctgcattattttatcttcattgtgtcatactaatgtggcagaccaggactcactaacacaggcctccataacaactgtttcagcactgactgagtggtaaagttaaatattaaaagctgatagagccagtgcccttatacaaaggctggaaggtaacaaaagcccaccaagagttttgcccaggcctttcctgggccctgaagcatggcaagataacgaaggaattcttaacaggacctttttaggattaaaaaattttattgggggtctgaagaaactccccaggcctccacaagcaagctttattggggactaaaggaactccccaaacctccatgacctaccaggagacaagataaaggtaatcactccagcaccaggacccatttagattaagtacatttactgaggcttcagaggaaggtcttcaggactcagatcttagttatagattaaaagaagttaatcacttctgtctttagatgaatgcacacttacatctagacatatagcttagaaggtatataagctctgaaaaacattgtaattttggattggtctggcaataatatccaggccttctccctgtaactggttacagaaataaaaactcccttctctcctagttcatctgcatctcattattgggccgcaaggatcagcagcccgacccttggtttggtccgggaacactaatacctaatattcccaaatgtatgttggccttgccactgtgaaggaaaattaaatgggagtcacatgtcctcttatgttttgcatttgtgttttgctctgcgtaaaaatcatgcaaacacactccagttgaaaatggatacagaatcgaaatagacatttctctgaaaaagacatataaatggccaataagcacacgaaaagatgctcaacataaccaattattaggaaaatgcaaatcaacgtaacagctgagagaccaacctactaggatggctataataataattttaaaaaacaggctaggtgtggtggcctatatctgtaatcccagtactttgggaggccaagacaggaggatcacttgaaaccaggaattcaagaccagctgggcaacaaagcaagacctgtctctacaaaataataaaataaaaatgtaaaaagtagataataatgaatgttgatgaggaggtggagaaatgggagccttatagtttaaacatagagtaccatatgatccatcaatttcactcctcagtatatatccaagaaaaatgaaaacaaatgtccacacaaaagctgatacatgaatgttcataggagcattattcaaaatagtcaaaaagtggaaacaaccaaaatgtccatcaattcattaatgtataaataaaatgtgcaatgtccatacaatgaaatattactcaacaaaataaacgaactaagtatggatacatgctacagcatatatgaaccttgacagcatgctaagtgaaggaagccaatgacaaaagatcacacattgttgattcgatatatgtaaaatgtccagaataggcaactcggtagaggtagaaagtagattagtgcttgcctaaggctggaggattggaaaaatgagaggtaactgctgatagttacagggtttctttctggggtgatgaaaatattgtaaaattgattgtggtgatggctgtacaactctgtgaatatactactattgaattgtacactttaaatgggtgaattgcgtgttatgtaaattatatctcaataaagctgatatacacacatacatacgtgtgtgtgtgtatgtgtgtatgtgagtatgaattatccaaaggatttcatatgagtgtttgtgttttcaggcaaatatcataggtatacttataaagaaacaaacatggttctctttatcttctgtaggcctcttggcaatgctttgcaactctctttttacaataaccttacattctctgggcatctctgatagatgtatggaaaagcaaatctgggagcaaggaattcttagggaaaaaagcttgcatcctacttctgccccaaattgttcatctccttggaaaactagatgtggatgaaatatgtaaagcaacttattctgtggtttaattcaaaaactatattgaagttccttagttggctttgcactgaggcaggaactctgggaaaacaaagacacgtgaaacagagagattactgggtaatgggataacagtgcatgaataaataggtcaactactaacctgagagataaatgtaatacaagccataggtatacctgggataaagaaggcttttaagtagagcagtaaataataggctgccttctggctagatagataacagtaaaggggcataattttatccagtgaatgtaaagcacacgacattggagccaaacacatattaaagcaacttctcagaaaattgatttctagtatatgtcaaaggttttatttatttatttatatataatatatataatacttcaagaaagttaagaataatcctattcaagaaagattctttaccttcatttgctataagtttgaataacacctttgacatatactacatatgtgtatatgtgtatatacatatatatgtatatagtatagtatgttatatatacatatatagtatatgtatatatgtatgttatatatacatatattgtatatacgtatatataccaatattagtatgtatgtatataattgtatatacatatatacatatattagtatatatgtatatattagtatatatacatatattagtatatatgtatatattagtatatatacatatattagtatatatgtatatattagtatatatacgtatattagtatatatgtatataattgtatatacagatatacatatattgtgtatatacatatatacaatatatgtatgtataatatatacacatatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacactctatactatatatgtatatataacataccacaatctatactatatatgtatatataacataccacaatctatatatgtatatataacataccacactatatactatatatgtatatataacatactacactatatactatatagtatatataacatactacactatatagtatatataagtttgaataaaacctttgacatatactatatatagtatatatcatctatatataatacatagattgtatatataatctatatataatatatagttagtatatataatctatagataatctatagattgtatatataatctataatctatctatagataatatataatctatagattatagattatatatacaatctatatataatctatatattatctatagattatatatacaatctatatataatctatatatataattatatataattatatataaaatctatatatataatctatagataaactatagattatatataatctatagataaactatagattatatataatctatagataaactatagattatatataatctatagataaactatagattatatagagattagtatatataatctatatattatatagagattagtatatataatatataattaagtatgttaatcttaattgcttgataaatttttaaacctatgtaaccacaattcacaattcaggttatggtagagaacattcccatctccccaagttgctcccttgtgccacttcccaatcagtactactttatcttacccaggtaaccatttacaagttttgccttttcttgaacttcatataaatgatattacactatatgtcctcttttgtgcctagtcttctcttgccctacaaaaaaatgtctgtgagcatcacccatgcttttgcatgtagcagtagttcattcctttcaattactgtgtacgtatatttatgactatatcacagtttacttgtctatttacctgttgttggacattagagttgcttccagtgtttggctattataattaaagcatctgtgatccttattgtttaaagcttttggcagaacatgcactaatttcttttgggtatatactcaggagtagaattgttgggtcattgagtttgtataaattagcatttggaaatactgccaaacagttttccaaaggagtggaagtgtacatatttacactccaccaagcaatgcattggagtgccagtagaatatattttttaaataagatgagagtatggctagatactactgttaaactggataatagaaagaaggtctggttctggaatccaaaccaaaaaatgactgggtgagtcgttaatgcattgtgagcatagatttaacttcccagacaggtcttctgatggctgattttatgtgtctatttcactggtctaagggataaccagacaattggtaaaactttatttctgcaagtgtatgtgagttttctggaagagattagcaatttgaattggtagactgagtagggaagcttgctctcaccaatgtgggtgggcatcagcaaatacattgaaggcctgaatagaacaaaaaggtggaggaagggtgaatttcctccctgtttgagcctgagacatgcattcatcttctcttgcccgattagtgacactcctgcttgtgtctgcatcactactccctctttactgaccccatccccacttgttttcagtcctttggattctgactgagttataccaccagctttcctggtgctccagcttgcaaagggcagatcatgagacttctcagcctctataattgcgtgagccaattcctgtaataaatcaatctctctctctttacctatgtctatgtctacatctatgtctatcacctttgactctgtttctctggagaatcccgacagagctgtaaatctaaacatctattagaaaaacgctcaaacatttttatcagaaatgcaaaatacttccaggagtggttgttaattacatcctcaaaaagccctgctcaaagacttaagttcaaagctagatataccatttaataattgtatgatctttggtaaattacttaacttctttgtgcctttctttccttagctgtaagctggggacaataatatctacctcataggattagtctagggttttagtgtctggcacagagtaagtgttcgattagtttttcttttccttccttccttccttccttccttccttccttccttccttccttccctccctccctccctccctctctctctctttttttctttctttctttctttttcttttcttttctttctctctcctctctccttccttccttccttcttctgaggtcaagtgtaaattgcaaaagagtaatgccattttgaactcttaaaattatcttaacaaacaaaattatagggcaacattgagaaaagtgggatggtggaggatggttagggaaaagaaaagaaaaaaacgtaggaaggcaagacattatgtccccatccttaaaataatgttctctctcggaggtggttaagtaatgtgcagaatagaacacctgatattctaaaaattaaacttcattgtctatatcaatattaagcacattagaaaatagactgattcagctttaatgatatattacaagtggatttgcattgaattgaagctaggtccatgtgaaagtgtatcaaaattaaaatctcatttgcatatatagcatcagttagtacaaatgttttttgcatgattatgctccctctaggagaggccattaggttgatttgcattcatttaaatgttcatgtgggatgttgattttgtctgtgcaattactagggtagttaatacattgttctattaaaacagctaaaagactgcacagatgctgtaacatacaaatgtagcaattgatgggttgattggaaggaaaccttctcacataaacagtcatcttttcttcagtgtgagcaaaataactgaaactgattcttctacacaaatccctctcaaccagtgttattcttgtgtcctggattcacaaatgaatggagagtctttttttcaatatgcaaaataaataagtaaattacatggtatgctagaaggtgtggtagcttgcaaatatggccacaaattcttcttatccctctttgcacatctgtttatcatgtttccttgcagcatgtctttgcagctcttctcaccaagaattggagtctattttctcaactcattaaatctgagctggctgtgtgacttgctttggccaaaaagactttagcaaataagatataagcacaagcagaggtttgaaaagtgctggttcgctggggcttactgtattactgctcttgaaatgctgagatgaccatgtgaatgaatccaaggaagcctcctggaagatgagaatgctgcatagaagaaaacagaggtctccagctgacagcctgccaaacactagaaatgtgaatgaggccattctggatcatcttgtcaccagctgacctcccagctgactatcagtgcatgagcaaacccagaaaagatgagctgagccagtccagtgtagaagaattgcccagccaacccacagaataatgagctgaataaaatgttgttttaagccattaagtttgtgatgttttattactcagtaatagctaactggtactgaatgttataattactgcagagaaaaatagagcacagagggaggaagtagaagtgtatatgtgtatgcatgtgtgtagaggaggggctgttgaaattttaaataactttgtcagggaaggccttgttgagaagatacatttgaacaaacatttgaaggagatttaagtaattcatgtggttatttaagagaagaacatggtaggcaaaaggaatggcaagtggaaatttcctgagccatagcatgtctggctctttttgaaggaaagcaaagaagtcagagtgctggagcactataaaagatgagggcagagggccgggtgcggtggctcatgtccataatcccagcactttgtgaggccgaggtgggcagatcacaaggtcaggagttcgagaccagcctggccaatatggcgaaaccccatctctactaaaaatacaaaaattatccgggcgtggtgtcagacacctgtagtcccagctatttggaaggctgaggcagaagaatcacttgaatccgggaagcagaggttgcagtgagccgagatcatgccactgcactccagcctggacaacagagccagactccatctcaaaaaaaaaaaaaaatgagggcagagggcagagagttaacaaggggccaaatacatgtctcatgtgagagtatgacaattaatcaacatggaagtaaaaaactgacatgagctgaaccgatcagtttctccctcctgaaactgtgaaacttgagacacagagccccagagactgggagatgttggagctgaagtcaccttactggctgtcatagcctgctcagtctgctacaccataagtactataaactgggtagcttataaacaacaggaatttattgttcacagttctggaggctgcaaagtcaaggtgctgccaaatttggtgtctggaggccgggcacggtggctcacgcctgtaatcctaacactttgggaggccaagacaggcagattgcctgagctcaggagtttgagaccagcctgggcaagatggtgaaaccccatctccactaaaatacaaaaaatcaactgtgtgtggaggtgggtacccgtaatctcagctactcaggaggctgaggcaagagaattgcttgaacccgggaggcggaggttgcagtgagccaagatcacgcgccactgcactgcagcctggacaacaaagtgaaactctgtctcaaaaaaaaaaatctggtctctggcaagggccttcttcctcagagatagtgccttcaagttgtgtcctcacgtgggggaaggggcaaggcaactctctagggtctcttttgtaaggtactgatcccattcaagagggctccaccctcatagcctaatcacctcccaattgccccacctcctaatactatcacatggggtattaggtttcaacatatgaatgtggggggacacaaacattcagactttagcactgcctgaactcagggggccatagaattcatactttgttctagttgccaaatttcaggagctgacttgcttcttgtccttgtcaaggttcgatggttgaacttgttttttgagtctgtggaaccctcctgaatcattaaaatgaatttgttccagcactcaatctttttttcttaaataaagcaaagttaatttctgttgcttgcaaataaaaacgcttaactaatataattatcttgtgatttctctctagttctttaatatagtccttttcttctgaaatagattattagtttcttagagacaggaataattctttccatttattttatatccttcctctatgcagctatacttataggacaagataataacagctaggcattcattcaatgattataatgtgtcaagcactgtgctaagtacttatgtagattatcttatttaaacttcatgagaattctgtgaataattactctgattatttctcttttttatagatgaggaatcagaaaccagagatgggacatggctaataaatagtggagtggagactcaatcctgggcaatctcacctaagagcccacattctttcaggacccagcacttagtaggtacttaaaaatacttgtgtatcgatatattgaaaagtactaagtatccacaaaatcacattcattaaaactttggtttgcagtaagaatacttgagacaacgtagaattttgaataagaatcttataacataccaaggaagaaaatataagaagtattatttgtagaaaaattcaattattcccagtaataaagaaaaagcattaatctattatacatcatttattattattaatctttattattattgttattttagagacgggccttattaggtcgcccagggtacagtgcagtggcgcaatcatagctcattgcagccctgaactcctcagctcaagcatcctcctgcctcagcctcctgattagctgagctaatgaggctcaggcttgagctaccatgcccagcctacataaatctttgatatttcttctaacagccctaaaagataaggtaggtattatcatgctcacttaactgattaggaaacttaggctcagaaatttaagtgctttgttccaatctgttaacacccaaccctaaaggtgctagattcagtgagctgaaaatgctcactgaaaacgcaaaatgcaaaatgcctaatccttagaaccagacactccagtcaccatttatttgtccatgtctgagttcacaacacatcctctctccctatttcatttgccatttaattatgtgctgccccatgacactggtgtgctacttcataattatgatcgtgttattttagtgccatgcagcttcattgtaattttacttgtgagacctttttttaatatattgggtacctataagaatgaaatatttccataacaaaacagatttacagtcagcttgtaatggtttaatgccaagatgttatagaactatctaccaatgaagaaagggttgaattgaatcagataatgattatatgggcttttcaaatttaaaaaaaacaagcaacacttcagagagaatttatataatttgcaaatataggtaaatatgtaagcaaatcttcattatatcatattcagtatttgttctcttaagcataagagttgtgcttgtccgtatagaataggctgaatgaaactgaaacaagtcttgctttctataagttaatatttggggattggtcacacacaaagacacacacacacacacacacacacaatggtgagggaggggcttacctcttttatttactgtcccattcataatgcctagaacagtgcctggtgcacagtaggcaaatatgcactcaaatatttccttagtgcctaccacaggccagatagtgttctaggcattggggatacagcattgaataaaacagaattcatactttcatagtttatattctacaaatgggagacagaaaataaagacataaatgaatatgatatttagtatgtcagatagtgataaggacaattggaaaaattaagcaggaataagggataaggtgggagagttgccattcaaaataaagtagtaaaagaagacctcagtaatacatgacttttgaaggaggcagtcaggaaacatttcaccagaagatgacaattaaactgagtcttgaaaaacaactaggagttttccaggaagacaagaagggagaaatatatagaagatgaataattcactttgaattctaatttgcatctccttttacatgtagtggcatcatttttaaggcagatggtgtataactttgctccagagttaagaattctctttcctgaaagctccagggataattctgattggttctgcttggatcatgtgtccatctctgaaacaattaccatggccaggcaggtagtgtattcttattggctggcctgggtcatgtgcccactcctgggattttgtttttttgtgtgtggagggggcttcagagcccctactctgtgtaatcttccccaggagatcatcagttaggggaggcaaagaaagtaacttttctctttttgatctatcagggtttgcaagttcctttgaaagaagagaattacagaagtattgagactggaaggagcacttagtgcaggaccacaggatgactgactcctcagcacagcttagcatcctggtgccaaagtgggtgcttcacaaagatttattgtataaatagagaggactatcacaaaccacatgttgactgaatgactccaccattgtctaaccactgattttgaggggatcccttgggactatcccatagatccaagttcaccttaccttgggagcagatggaaccagaccccaggtgctctgccatgaatctccctcaggtgatccgggcatcccaaagatcttacctcatagaagctgttgtagaagcaattgcaggaagaggcattgatgcagcgttgtcattaagcaaaaagccaggactgctgacactaccctgccagcagacaagcctgcagctgggcctgaggctctcacaggatgcaaggcaagcacaggattcatatgagggacaactatctaaccggaaaacacaaaacctccattaagccttcgctctgcagcttttctcagagatccttcctgtctctcctctacactcccaaactgaagttcttctctaagaagtaggcccatattattcaatcataagaaggaatgaagttctgatgcatgctacaacatggatgaccttgaaaacattatgctcagtgaaagaagccacacacaaaggcccacatattttataattccatttgtgtaaaatgtctagaataggcaacaaatgaaagagttgagtattgtgtaagggaagtttgagattcctattgccattcaggtgaggatgttgagcaggttgctcaacaggttgcttgataagtgtctggagttcaggagaaataaccagtccagaggcataaatttgggagtcattagcaaataattggaattttaaagcatgagactagattagactacatgggcctgataaatatttgataggtaataaacaaatatacacaatatcttctgctataacacattatctataacaaatagtatatatgtaataggaaataggggaagaatgtcaataccatgtggacgttgggttgaagtagaattttaaccttcagcatgaaaggaaaaatccctcaatttggctgctgcagtgtcaaaagcccttttagctttatttatgttttaaaattaaaagtgaggttctacacccagggcttcctctccaaggaagtagaccctcagccttgcatgattcttgcctcaggcagagtgtacttcttcctgtgcgcaccttaatagcagcctttctgtcttagacttccacttccatctgcattgtctcagctctctcaagtagaatttcctctctattggtttcttgcatgtttaatatctactgaggtggcctctagccataacaagctgtgtgtctgagctgtgcacaagtcatcacctgatatattattttaaaaaaattgttaatgctctgcttataaaggtacataagttttgagtgatctgccttaactcttatgccttgttagttttagtgtgtgattttgaaaaatgagagatttttcagccgagtatgtcattttatgtcagaaatgcttgtatacatataattgacatgctacttttgttcacatctttcctggcaggaactgaaaggtatttatatttatgtttctctccctccgccaaaataaaacaaaacaaaacaaagaacaaaaacccaggaatgggcacatgacccaggccagccaatcagaatatactacctacctggccatggtaattgtttcagggatggacacatgatccaagtagaaccaagaattgtccctggagttatcaggaaagagaactcttttaactctggaacaatgttacacaccatctgccttaataatgatgccattacaagggaaaggagactcaaattaaaattcatttatgcagccaaaaaacacacgaaaaaatgctcaccatcactggccatcagagaaatgcaaatcaaaaccacaatgatacaccatctcacatcagttagaatggcaatcattaaaaagtcaggaaacaacaggtgctggagaggatgtggagaaataggaacacttttacactgttggtgggactggaaactagttcaaccattgtggaagtcagtgtggcgattcctcagggatctagaactagaaataccattcgaccccgccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaagggcaaaaaaccaaacactgcatgttctcactcataggtgggaattgaacaatgagaacacatggacacaggaaggggaacatcacacactggggcctgttgtggggtggggggaggggggagggatagcattaggagatatacctaatgttaaatgacgagttaatgggtgcagcacaccaacatggcacatgtatacatatgtaacaaacctgcacgttgtgcacatgtaccctaaaacttaaagtataataaaaaataaataaaaataataaaattcaaagtaaattactcatcttgtatatatttctcccttcttgtcttcctggaaaactcctaattgtttttcaagactcagttcaattgccgtcttctggtaaaatgtttcctgaccacctcctgcctcctccatgaagtactgtgagcttccttcttattcccacagcacctttgtacacatttctcttacagcattgttatgtaactttgctttattatctgctcttccccttcccccacccctcagtctgtggcattcttgatggtagtcacattaccttatccatttctataaacctaggacctaacacaatgtctagtatgcattaggtgcacagtaaatgtgagttgaatgaattaatgaagatatggctctggtaatatatggctgattgctttgcgcaagaagacacattgtcttggaggcacacacgcacacacacacacactcactctctggggaatgtaagatttttgataggtaagaattttgatccaatcttaaaacaaacaaaaaagaggtgtgtgtggggtggtccgggggggggggtgatatttcctgcaaggtagggttcgaggaaaggcacttcattaaaattaaacttgaaaatagggcattgggagagaatgcagagtgggggggactttagaaaaagagaacaaataaaattggaaatgaaacactgccttataaaattagaaaatagaggtagaaaaactgaaggctggtattattcagggaagtaggtatagacaagcaagaaaagtaaaggtaaagaaatggaaaaagatggaaagtagaggtgggagccagagacagggggaggaaggtcctggatagtagacttctgagctttcaataaagctttattttccactatgtgttaggccatgtgctgggttattagtacattgaaatgagtaacttatattccctacgcatccaattatgggggagatctcagtttataatggtataagaaagcaatgggatgacaacaaagggcgagtgttaggggatattgcccactttttgaaattggacccccatcctttaccagagttgtaagaagtctgacagctgaaatgctgtcctcaagttgagaaaatggcccaccccttccctattcttgtttctttctctctgaactctataatccctcacccttgccagggctaaaggaactctttttatacattttcttccttccagttttgatatggtgaaggcaggactgagggctcatcacccctacccctcctcctagcagaacaagttgacctttaccagaacacaccaggtcatgagtcagaattcccatgccatgtttgctgaagctattaactcttctaagtcctggcaccccaggacatcttgaccgtcccaacgaagcactgccaccaaaaccagtttgggtggagccttggcttttcttactccatgtcaaattaggaaggtgacccctggcaccagggtcccatcattccccacagtacttttccaagacccaggggggatatgagagaggagagacttgcagcctcctccacaaggaagggggctcctaggagatgagatgggagtaacttgtgccttggctgtggtgagcagtaggggtactcctggtgtaggtacaaactgtgggaggtttgggcatagccatatccaccttgcaggtggatgtgtcagatgggccatggtgtgtgtgtgtggggggggcgtggggggtgacagttcctgcaaggtagggtccgaggaaaggaaagacctatggaaaaggatacacctgggatcttgaggagccagctgcacctgtttctgggctgagaggcttccggagccaccacaaggtggagaccaaggatggcgggggtggggtctttgcagaccggttgttaagtcctggggctggctgtgcatcctgaagcccgtttggcacagcctgcaggagggactttgcaaagccgcgtccaggtagtatatgaaaggtgtgttgagctcaaatggtcagcccggggtcatggggtcctggggtggcggggagccgagaagagggagatccacgaaggaggctttcaccccttggcagcgggcggctgccttgaggggcgggctgtgcctggcgcgactctggcgccgccgcctgggggcatccggctgtgagccccgtggatggggcgcctggagaccgcgtctctcgaggcactaggtcctggtacttgctgggggtggggagggagaggggcgcacagcgccgagaggcggacgccaagcgcgtgagtcactctgctcccctgggttaggagcgggactttgcctcccgcctggggtctgcatttcagctccagcttcagtgactcatcccagcaggctgaccccctcctgaggctggaccagctgcctctccgtctaggtgagggccaggcaagtttctcgtcttctgatgcttactgtttgggggactcgcggggagggggtcttccagcctgtgtctgtctgcctttgcttcctccctctggctctctccattggagacagaaagttagatttaaaaaacgcaacagagaatataaaatctatgctcagaccccagataaacaaaactctggggccatattcttaatttaccgggtaccttcacatgtccgaatgcggcgtttatggagctaggaatgttttatttgtttcgtgtatttccctcctctcccccattttcctccggtgtaattcttagaggtggggacaggagagccagagggcttagctgggatcctttgccagagtggcttcttcattctctgcgaggtagcagatgttttactgtagcctgagttgggatcttggaacaaccctctccagcccaggacatgccagcgcttaaggtaactgcagttgttgcatatctatctcgttatcactgactgaatcgaaatgttccggaggcacaattaatgtgaatgccagaatgttgaaacaattcattgaaggacactattgaatgttttattttcaaagtatcgtattccaggaaaattttagaagactattgctggttttattttctctattttcagatatgctccaaagcctattattcccttgcaagacaaccagtgaggacctattctgtttcttataaggatttaacagtgcaaaactacgtgttagtttctcctctaaggttagggacctccttctgttaacctcttttagaaaaatcattttggtggtggtggcggggagatgtttcccctttctctatcattaaatgcaaaatgtttctgtgactattaagtaaatactaattattgttatttttgcttaaaaggagcagaggagagcatctcccagaatgcatgaatttgtggttcatattgataactgattgctttaccatcaaattgtttggtttgatgcaatgttaacaagtggtcttaattcacaacacagaagtattctattccagaaaacaaccctgctgatatgcctgccacccccaccccaaaatgcacacacaaaaccatgtttttgtcttgctttgtgggagagaaaaatggatggggtatcttttctggcagttgattagtccccgatctttcttgaattgtcatttgttttataacctataattatagaaaagaaccctccttgaaataaaattaataaaaccttacatgtttagtcagatcacaggaataattttttagagttgagtggaagcttccatgatcctcttccaatgtcgtccccggggagccgttaagcttcccacttctctgataacataactcctctactctacatacctctatcttagctcttaccaccttatgattctaggtttacatatccatcttgcttagagtaataaaatttatttggaagcaagggtaatgccttattaatctttgtatccctggagcctagtaaagtaaggtctgttgaaaaaaaatgaatgaataaaataatttggcagtccagattaggtttaccattccttgaaatccacctgtgcattctttctcttcactcctaaaagataagtcatttaattcaatggtactcaaagtgtggatcctcagaatacactgtgttctaaataaatgagagttttctatatttgaaaaaatctatatattgttgtgaactttaatatttaattttttattttttattttttatttttttgctgaaagtaacagaaaagccaactaaacatggcttgtaatactacagaagtttagctgggcgcagtagcatgtgcctgtggtcccagctacacaggaggctgaggtgggaggatcccttgagcccaggattttaaagctgcagtgagctatgattgcaccactacattctagtttgggtgacagggtaagaccctgtctctaaagaaaaaaaaaaaaaacaaagaaaatagagaaggctgacagtaggtaataactggagttgatacagtgacccaacaatatcagggttctgagtcagtgtcttaccctcatggcttcaagatggctctaacagctcaagacactcggtcctaatcccatgttcaatgacaggaaacggggtggaaaaggtcagagtatttttcctcatgcaactttctcatcagagaaaaaatatccttccccaaatttatctaacagaatcctacttttatctcattggcaatatctggggcacatagctgcccttagtggcaaaggagactgggaaagtatccgttttttcagcttctatagtggaaaggcagccagggagaggcaggtaggtgatgtatttggggaactgaccagaaagtcttctagactgtcaagaaaataagtctttttgaacctgtgatcgtatcaatgttctggccaagtaaaatactaaatattaatcaatgtagcaaaagcacacatttagagcagatttcccctctccacatgggtatatggtattttaagggtgccaaatcacttttatggagtgtgctaacttttagagactgcaccttgcctgtgtgtgtgtgtgtgtaatctcatagggtttctattaagtatggatcaaaccctcaagttcctggaaaagagtaaatattcagtaaatagttgtcctttgagtggagtgttgagtttgggagcttcaaaacttcacagggacatgggaaaggatttagtgaggaaaaaaaactgatgagtggtttgctgccaatgccttggaaggctggtttacagcatctgaatgtctttaatttggatcctaggagcctggagggaaacttaacaagagggaaaagaagaacctagggagaggtagtggcactgacaacttggttcaacagattatctttggggaccttctctatacctgtactggggaagatgtactactgcccccctcccccacacacagttcaaaatggtccctagcacacacacacacactaaaacttaaaaagttgaagcatgaaaagagtgtatattattgcccgctttgatttaactttctcttttccagtagaatattctctcaaatacttacagaaggtagtttttggacatcatggtgggagatcagataagcaagtatcgagagattgaaatttaatgattacaattgtcttagatttctcatcaatgaaaagaatggagtagatcaagcttgtccaacctgtggcttgcaggccacatgcagcccatgacagctttgaatgtggctcaacacaaatttgtaaactttcttaaaacattatgagattttttttcaattttttttttttagctcatcagctatcattagtgttagtgtattttatgtgtggcccaagacaattcttcttccagtgtggcccaggtaatccaaaagactggacacccctggagtagattagcagtggtattcaaactttgttgcacattaaaaattacctggggaggtttttttgtttgtttgttttctgtttttatttttttttttgagatggagtctcactgttgttgcccaggctggagtgcaatggcgtgatctcagctcactgcaacctctgcctcccaggttcaagcgattctcctgccccagcctcccaagtagctgggattacaggcacctgccaccacacgcggctgatttttgtatttttagtagagacggggtttcaccatgttagccaggctggtctccaattcctgacctcaggtaatccacccgcctcagcctcccaaagtgctgggattacaagcctgattcatcatgcctggctggagaggtttttaaaatcaagatttatgagctgatcctcagaccacttaaattggaacctctgggaatggaacccaggtatcaatattttaaaaactccctagatgactccaacatgtgcctgagtttggaaactatattagtttgctagggctgccattcaaaggaccacagactgggtgatttaagcaacagaaatgtttcttctcacagttctggaggcaggaagtccaagatcaagggttggttgatcctgaggcctctctccttcacttgcacctgaccatcttccccctgtatctttactacagtcttttctctgtgaatgtctgtgtcctaatctcttcttataaggatgctggtcatatattgtgtcagggcctagtctaaagagctaattttaacttgattacctcatcaaaggccttatctccaaatagttatatttagagcccctgaaggctgggacttcaacatgtgaatttgggggagacacaattcagcccatgaaagaaaccattggacaagtacaacatttctcaaactttaatgtgcgcaccagtcacctggaggccttattaaaatttagattctaatccaataagtctaggtggggtctgagattctgcagttctaacaagcccctagtgatttcaatgttaccagtttacagatcatacttgaagtagcatggttctgtctagatgagtggttctcaaactttaatggacatcggaatcacctggagaaattgttaaaagcagattgttatgatccagccccagaatttctgattccataggtgtcggggtagagcccaagaatttgcctttctaacaagttcctggatgatgttgatgctgctggtgtagggatgatacattgcaaaccatgtatctctgacattttgagactttatggtattggatgagtcagggtcattacatacatcattgtatgtgaagtttgtaattctaattgctgatagcattactttttttttttttttttggacagagtctcactctgttgcccgggatagagtgcagcggcgccatctcagctcactacaacctctgcctcccaggttcaagtgattctcctgcctcagccttccgagtagctgggattacaggtgtctgccaccatacccagctaattttttaaaaaatatttttaggagagacgaggtttcagtatgttggccaggctggtcttgaactcctgacctcgagtgatctgcctgcctcggcctcccaaagtgctgggattacaggtgtgagctactgtgcccggccagcattacatttttctttttgccaagcataattactttttctgttaataggacgaaggatgagaaagtgggagaaaatgctgtattgggatttcttttaatctcatacaaatagaagtgaataaatacagaggctacacatcagcccattagtctctattcatgtttgttctccaatcatagagctattttgcagcttgctcttctagaagctcaaagctgattttatgagattggttgcatacttctcatatgcgatttttaaaggattaaccattctagagatttcatggggcattgcaaatttcccccctaaaacattaattttaaattatttctaatttaatcacacaattgtttctacacgagaccaacagtgagctacatcaaagagtatcccctccccaaaattattggatatgaagaaaatattttacctgacttcatagaattaaatcggtaaaattcacattttgttactgttattagaaaatttgatatatatatatgtgctatatataggtgatatatatacacacacatacatatacgtacatgtatattgtatacacacaggttatgattttctatttgcttaatttaaagcattttatgttattttaaattgttcttaaagctctatttatatctccatatgaaacagtgaaaatatttctattttaaacttaaaaaggtattcaacttgtaatccaataagtattttaaacaaagatgtaatcaggtttctagctgccccatttactctgggcctattatctaaagaatgggtcttgctaaagtatttcccttacaacttttccaaagttatgccagatgtatagggcttctattaagaatagatttactatgccataactgttttgagtttaccctcatagctttcccacatgttccacattcttggtgaatttttccagtaatgcacctcccagcactgtcaatgggaagaggttacctgtcatgtttctagcctgagcttctgaccaccagataacagaagcccaattgtggagatggatacaacaagcccaatgccgttaaagatctgaactgtataattaattctgtttctcctgacttcatgctcagcagtcagccttaggatgccacatgttcattgccttcagggtgagaataacctggtcagagtgtctggtctccctgacagttatatctcccattgtaaattactaagccgccactctagctttaaacacttatgagtgttgtgggtgtgagtcagcacccaacaccctcaaacctaataaatacagggacactgataaagatcagttatctgggggttggctcaaagctaggccctgatgctgatgactcatcgaagtgaattaataccagctagcatttattaagtattttctgcataccagccactgtgcaattttatttatattatcttatttttcctcataacaactttgtgaggtagtcatgttaatttccattttacaaataagaagactgatatatgtatattaaaaacctgctctaaatcaaatgactattgtggcagggactttgagttgccatgcaatatctattcccaccttctcccttagtggcagaataccagttttattactggtaatgatgtatctagcaaatagtttctatttcctggcatcccttgtatcaaggtgtgaacctatgactgagttccaccagtgagaggtaattgtgttgtgtggtacttctaggaagcctgcttaaagggatttgacttggctgggaggagggcccttttgtacctcccccttcttcctcctgctgttagtcttgaatgcaggcatgatgcctggagccatcttggaccatggagtgactgactggatgtaagctagcattaaagatgctggaacagaaaggtagaagaaatctgggcctgtggtggcaccatggagctactgtgccagctctaccacagagatctttgtctgctattgaaaccaattggcattctgtcagcagagatgaaaggtagagttggctattggtaggcagtggacagtgttttcatgctatataccaagtacctaatatttgatctgtgatagatacatgtgtttgagtttcatctctgccacttactagctatgtctattggacatcttttgtgcctcactgcacagccttatagcctaccatttaattaagccgttagtccattaaccagctttatgtgggtaaaaccagagagtgccttgccttagcctcacagcaaatatctcacttctcactccaggacttctttgatgtttcaacaggaaggcctgttggaacactcttgtacccacacatgtgtgttatggaatgtgagggagttaaaggcccaagagccaacccttgaccaatgtgagatgggaacctaagataaatagtccctcctccatccttggcctgataattctcaattgccttttaatagtgtttgtttccaagagattctcagagggtctaactaagtaggattacgccctagttgtttacagttgtgaccaactcaaaaatacactcccgtattggttttctctcttcttttcctttcctgaatttcctacttctattccctagtatcacttccccaaacaaactacctacattgaaactcttgtttcagcctctgtataaccttctgtgtaaccttgaagtaagctatgctgacaaaactttttagcacttgctgacatttttatgtcccttctatgatgaggcaaaatactatctttggtgtacaaagatgaaaatacatcatgagatctgataattccaactattgtatgaatgtggatcaataggaactcatactttattgataggagtacaaattggtaccattctggaaaagaaaatttagtactgtcttgtgaagttgaacattttgcataccctatgacctagcaactttatttctaggtatatcacctagacaaatactcctacatgtgaagcaggaactctccttaggaatggccatagcaacatggttcataatacaaaaattctgaaataatctaattgtccattgatggaaaaatgataaataaatttggtattaattattatttcaacagagtaaaaatgaattaaccatttctctatgcaagaacacagatgcatattattaacaaaatcaccaaaaacttcatgcagttgggtatcatttttataaagcccaaaaaaaagcaatactacacaacacattcttaggaatcatacacacatgatagatcctaaaacaaggtgaacccaaaattcagaatagtactggggagacagagatgggataaggtaggagcagatagtagaggtacgaacattgatgatgttctgggtcttgaatgcggtgatgggttcataaaggctcatttagtattactctttataacttatttaaattgatacagattcttttatatacatcagattttatgtaataatttaaagaaatgaaaccatcaccaacaaagatgctgtactaacaaaggacagcctcagtgaaaagcctcctctagccctcactctaaactaatggctctcagagtcaatgtttctcatcatgtaatgtgtttttttcttttgtgttgttaagtatattgtaatcaactagaatggcagggtacaagattccgtttttcttacggcccttcagggtcacatcctctagtatatttagaaaaacacagtttgttgtgtcctctctgcgcctgtgtccatttgcctgtgattcttctatatgtcctgaagctgcccattgctctttgctgtgcacaatccacctcttattttactgctgtctcagcacagcacacaggggctacgttcctccttgtttcgtgtgtgtgtgtgcgcgcgcatgcacgtgcacaggcgtgtgttgggtaaaatggtagtgagtagggaggcagttgacatgacctttttctttatacttccaaacctactccttgctttccttaacaatgccaccaaacaaagcagtaaaactgtaccagatttttgaattttgggccaggatttgtaatctttaaatcatttgtgccctggaacctttgatgaagtcggtgacctccttatcagaatggtggcttaaatacataaactcaaactcactggattacaaaggaagcaaattgtattgaaatacggttatcagaaattaaaagcaattgtgtggtatagtactctatgtactttttaattaagttattaagcaacaagatctaacggtggatctaatgacctaaattttaaagtagtaatgattttgaaacatattacatgatatctacaataactgtaatatgatatgaaaaatatctgtttctttagtgacagtcacgggtactgctaatactactgtggtttgttgcttacattcatacttgcaggaaatattaaatgtcagataaagattagtgaacataaggatgtcatttttttttcccatccaagttcatggactctttaaattctactgatatattcttgggggttcgtggaccccagattgagaaacttgctctaagcaaagcaaaggaaactacaacagatgtgggaaataattttaaactgaataccaaatattacctaacccacagcctacagagaaagcagttacctctaacctttcatggagggtaggagagccgtctcagtttccattcttacctcacagatctttttttttaaataataataatagctaccatttattgagcacctactctactgtgtgccataagaggactttacttttcaattttctgcagacaagtctccatacttccgttaggaactcctgcctccttctcaaaggatctgatcttgctcttggattcatcagtcttccttctccactaagagttgcccactttagaataactccctaatggctcccacacaacagcataaggtgggctttggcaagctgagtcttgtttcatttaagacctttacactgcagtgagctgtaatgagcggagcccacgcacccctcctaaccttccactaaaacacttactttcagggatagcacaatcttaatacataaggaaaaagaagcattttcctgacttctccataaattaaaagactgcttaagcatacaggaaagctagtactgtacacttattatgcagatcaggtatagttatttattcataccatagctgctttcaaatgggctcactactgagctatatagatcttgtgatggctgttttctgagctacacaaacacctggctccaagtttgaagtttctgtttgtatgagtctgattaggtgtttagatagtgctacttgtatcttctacaatacctactggttgaatgactgattgattttaattattttttcagaattagtaatggatttttaataaactttatttttagaacagttttggtttgcagaaaaattttgaagatagtagagagttacgtatacctatatccagtttaccctattaaaatcttacatcagtatggcacatttgctacagctgatgaagcaatattgatacatcatcattaactaaggctcatgttttattcagattttcggaatttttacctaatgtccttattctgttccaggatcccacgcagtcttcatgtctccttaggctccttttggctgtaacattttttcagattttctttgtttatgatgatcttgtcagttttaaagagtactggttggacatttcgtagaaagtccataactgggatttgtctgatattttttactgattagactggggttctgtatttttgggaggagtgccattctcataacatcatataaagggtatatactatcaacataacttatcattgttgatgttgaccttgatcacctggctgaagtagtgactgtcagatttctccaccataaagtcacatttttttctccctttccatactgcatgcccatatttaaggaatcaggaattatgttccacctccttgaaggtatttacaaaaattatttagaatttttctgccctttaagatttgtctcttccttccttcatttatgtgtttatttattcaataatttatttgtatttgtatggattcatggtaatgaatttttagctaaacagctccaatcttatttttggccagtggcatgaatttctgtcacaaactatggctagccctatagttcctaagcacagaaaagagtaaaaccaatagctacatacagaatttgtttcactattggtctattcatctatctctttccatttccttatctaattttttgtctaatttttcaccaaaagaataattcagtaacattaaaaaattcaaacataaaagagcacacagtgaaaattgctttccaccttttcatgtttttatatccctcttcagcggcaactcctgttaactgttactgatgtttttttcagacgttttcaatgcatttattagcaaatagctatcattctgcttctttatactctaaggaaaaaggccaggaaagggacagcagggcaacaaaaggaaataagaaaggggagggcaggagcaaaccaaagattatgaggttaatcatagaattcttaattcagttactacatttgcttggcaaacaattcacttttccaagatttttttctggtgtagttttcccactattgtgagtttcaacccctgatgatcaagcagtgtgggtatattacttaagttttttagttgaaaacaagtaaatcccctctgcccagtttaagcagaagagtttatttgaaggtattaggtggtatgatttttatggccccaattgtctccatccctaatcttgtcttttggacatgtgactttgtagtttctctcactaaggataatatctatatgtcccttgattctgaggttgactatgtgacttgctttggtgaaggagatgttagtggatatgaagcacatagaggcttgaaaaagcatgtgcacacttctacttctgtttttgttcctctgtcaacttcaggaagatgacaagagccaaagctagcctgctggaggatgagagacatgtggtacagagccaagtcatgaaagttacccaagctgaagctatcttggattgtctaacagccacttgatctccaggcatttaggcaagctgaattgcagctgactatagatatattagcaaacccagccaaaatcagccaaggccaggccatctgaactctgtagatttatgggataactaaatgcttatttttgtatgtcactgaaattatagggctgttgtgcatcattttatggcaacaaataactgaggatggtacttcaaggaatttctgggagaggcagagaacgtggtttggatgctacatggccagaagtaccagtaatcacactgcaggatgtttctagcaaacactttgcccctgctgcctcatggtgctcagcatctgtcattctggagaatagctattagaaccttcaccagtgctctccaaatgaactgaatgccttgaactcactgcttgaaagaatcactgacatccagcacaaagttcacattctcattccagtcatcccgtggatgcatctgactactagattataaaccacaattagaactctagctgcaagggagtctggaaagtgtgagtgagtgtgtgtgtgtgtgtgtgtgtgtttagctttctagcatctgcagtacaagaaggcctgctagaaggggtttggagaaagtgtgagtcattctccagtatcagccatggaggcatagacaaaagaactcaacttcccgatcccctgagtttcttctatctctgcatagagatggtcaaggtgttgacaggacttagaatcccgaggggaggacccctggaccctttgactactctacacagaacttgacatggcagttttagctctagaaaagcagtttcattctgatattaatgactaggggtactccttgtttttcctcccttggcatttggcaaagtgagtagccaggtgaaacaacactttattctaattacgttggacactataaacaaggagtttgacctcatttcacgttctctaaagctgagtaaaaggttatagtaaaaacacttagagaagtatattgtatattcttatatagggagaatataaaggaagaaagaaatctctgtctgccccatattcatatgccaattccctttgatctaagtatcctaaatacctaaaaggtgatcatattaggctgatacattgtaaactcacccttgctctttaaccctactcccaccacaagctagaatggttgtctgcagtgtctggtctgggacacatgtcattaactgattgatagaagacatttccacaaaacgaaaaggctttggatatagatgtatttatttgtaaagtgccacttgtaatattggccacatgaaacctttatttgttctcctctatttttcttctgaagaccttgttctagctaaatatttgctgaaacatttttgtaacctttttgtgttttaacttaataggcaaagccatgctgttgttgacactaaaagcacggaaaagaattacatttgggcagtattttaaggggtgcttttaaattaatctgggtgagaaattaagtatacctcgtatctgtatagataatatctgaatccttgactggttaccagtaaaagtaggagaaaatccactggaatatatatatgcttctgaagagcatatggtctgtgaacattcccaacagtggaacatgaccagagcatttactgggaggatcaaaagatattctgatgttgccaggatgctatttggcccatgtggatttgcgcattcaatcagtaggtttaatatcctttgtaatcaatgaaaaaatctgaataagaaataatagtccattcagctcacagggaatttgtgataaccactcattattattgttatttcctgaagtagtttaccttgtattttaccaaaaatatttgggacgaggtctgaaacttctgctcaccaaggtgccaaactggcatcaagacttcaggccatggaaaatctacctccacagatggagtcaaatctgtggaggtagcttttcctcctacacctctcactgcagctcccactactcctctccctgtagaatcgtctcctccagccaattggtagaactactggactctagtgatatcatatacatttctatattttttctgtaccctttgccatgcctagaggacctccctggctctctcttggcatctatgatctgcctggatgagatcaagataaaacttagccataaatccagaattcttgtggtttgctcagcctttgcccaccattctcttctctgaacttctaccatgtttatatctagcatctaggctagcccttctgtgcccccaatatgtctactcatagctaaaatgttagtttctggaggatagaccgatttgcaattctgtgtatccccattccctacatcagtgccatatggatacaataaatactcagttgatggaatatgatgcctagaacatctagcacaaaaaccacaatgtttaaggagcaaaattccttgcatttacctggagcttccttcacaggcccacctgactactgacttcattcttattcttaaaagggtcacatgatccctttcttacaaaggtcacatgattattttactgcttccctccagtaatagagaggaaagggctctgtattggtctttcatctcaattttctccttgtgctttctgtgcatgaggtgccaaagcagtgtggcccttgatctactcgcttgactgattctattgtttaatcgccacaacaaccctaagagtaagtgccattattattccaatttggagatatggaaactgtcatggagaagttaagtaacgtattatctcaagctattaactggaggagccaagattcaaaccaagacattacggctcccaggtctgtgctgttaactcctatatgaaactgtctttcctgatgcccaggtattccattagatgatccttgaaacctcagagtttcttgggtcagaaagtttaagtaaacggaagaaattacagatccgggaacctcttctgttattctcattgtgctaccaagaatcccacaacatcctcttggtggaagaaacaaatgattaggaatttagtatatgatattccctcaaggctgcaaaatacagtacttcagaattattcacatcattaagatcaaatctggtctataagtaaatgcagattcaggatgtgaattcacactaagtaaagtacagtggttggaattctgctattgccacttaccagttataatatgggtatgttactttacctcttttatctggcacttagtaaatactaaataagtattaactactatttctataccacaatatttccctgtttctctagccatctatgcttccttacaacaaagcacagtgtaaagctctttgcctccacctcattggattaaataaacaggtctgtaaatataagagggaacaataatagtgaaaaaattggatactcaagaagtctagatgatcagagtgactttgtttcttttgttaatgaaaggatgagttggacggaaaaggagtgagtcacactgacaacgaaatgctaccaatttaggatttgattcattattttatgaccgttgcttgtttcctgatgctattcattgcttattcattggaggaacaataatcccattttggcttttgtggttttatagctgagacatccactttgaagcacattagctacacctctccctctccctactacttcatcaccatctcaaacatcagaaaatcaaattttgaaaattgcccagaagtattgggtgtacaaaaacattggtttctcctttggaagttcttcctgtgagggtttaagcatggggattttatagaggagatgaacatcagggatatttgtggcaatgtcacttcccttctcttaaaatggtgttggatggagagcctccgaggtaaagattctcaaattgtctgcagttataatgtccaaatattcgggagaaaatcccatatggcaagcaataaaacaaaattattatgacttccagttgatgatccatttttaaagggatagtttgaagtaataaagtaagtaaatattagtctagggaaaatgtggatatactttatgaactatttaaatacaaactatcttttcattttgtgccatgacctgagactactcaatgaattttccatatgtatacatttgctcttacatgtgccttttggcaatgccctttattatccttgaaaacaaaggcaccactatagtataattcaaatgtgtctagttcttcagtccttagagattggtggaggggctgcattacctctccctttaatataaactaggaacatgattatttgagaatgttgggggtcactttcctctcccagtaagattgaggaaccctgggtatttttacgtgtgtcacaagcttaacgtgaattttctcttgtcccctcacttagtatcacatacataacagcttttctttcagtcacccctgcttcctagtaactggttctccatgatactactacctctctctgacccatttcatccccaaactgtggaaaacagcctctttctcaaaacccagctaacagaaagttgtcttgtttaaggcttgaggataataccagggatttacaatgcagaaaggaaatttaaaacttggtatcagatatattgtgctttccgtccattggccctgcccttttgcagggaggcacactgtctttactctccttatctcttggcctgcagccatgttgcagatgtccacttattcccctgctgtaagagtcattcttttcatatcctcaaatctttcttttcctctatgccagaagaagcaaaagctgtttacaaattgaccctgggcataacaaagacactgttctacattattctacagaatctgttcatggtttctccactagtttagtcttgagtgtgtagtaatctctcacctgcttggttacaaagatgcccttaagtagtgtttccaagaatgaaagaagtactgtttcatttattactctgaagagtaaaaatgactacaggttcaaaaagcatttttgatcctctagtccagtggtttacaaaggggaaatatgactatggaatctataacaaatataaactttatatatatataaagaatggcatacatatacgtatatatatatatctgtgtatatatatacaattctcagatatattctcaaaaggtttaactccaaaggttaaaggtcatggaactcatgtgcttagcagtaggaggggctccttgtgttagaaaaacatcactaccaacaacaacaattaagactttgcttcaaagaacactgaaacccacttagtcaatattgtgaatttcacctgcaaatcctgtttctaatttgatttaagtgcttatgatttaactctttattaattaccttggtagaagcaggtgacattcttagttaccataagacttttccctagtgtgttgttcaaaaaacattggtgttatttgaggaaagacttaatagttagtgacttaattctaagcttctgggtttatttcattcagttaagtatttaggcatatgtttaagaggttcccgccaaggttctgacactctaccagacaccgaagatgattcagacacagatgccactctcataaagcttatataacctcttggggaaaattgacacaatataaataaatacaaagtagaaagttctgcatgccctaaggtaagtctagataaaaagtaaatttacatcacttggtatgcaaggcagtataatttctctgactggcactttccagtagctacgtagggcatccagctttagcttcacgactttgaatcccatcagtcatgggttcaaatcctacctctgatacttaacgactatatggtcttgggttattcacttattttcactgaactttagtgtccccgtttatacagcaagcttactaatacttcagaggttgatgatgaggattaaatgagataacatatatagtatataaagtgtgtggcacatagtaggtacctggaaggtggcttctcttttcccattgctccataaactgaccaaatagatgtaaataccttaatgcgtgaatacttattgtatagcttatagaagaagtaagaagttacatcttccaatctgaaggcataaaaattttatgaaatacttgtaagttactttatcatgaagctttccctgactgccctatataaaatagcaagagtactcctaacctcttttttacttcatttttccctaccacatatctgaaatattacatatttattgtttctattaatttttgttgataaatattagttatacatataccccaaaagttgtacatgtacccaaaaggagtacatgtggtattttgatacctgtatacaatgtgtaatgatcaaatcagggtaattgggatatccatcacctaaactatttatcttttctttgtgttgggaacattacaaatcttctcttgctgttttgaaatacataataaactattgttaactagaatttccctactgtactatcaaatgctggaacttatttttttttatctaaatgtctgtttgtatcccttaagcaatctctcattccccctccccctacccttcccagcctctgataccaccattctaccttttatctccatgagattcacttttatagttcccatatatgtgtgaaaatatgtgctgtttgtcttctggcttatttcacttaacgtgatgactttcagttccattcatgttgatgtaaatgacagaatttcatttaaatttttaatcttttctaatctttttatggccaaatagtattctattgtgtatatataccacattttctttattcatttatccattgatggacacttgggttgattccataacttggccattgtggatagtgctgcaataaacatgggagtgcagatgtcgttttgatatacagatttcctttattttggaaatattaccaacactgggattgctggagcatatgatagttctatttttattgtttggaggaagctgtttactgttttctgtagcagctctgctagtttccattcccaccaacagtgtatggtgttccctttttctctgccagcattttaaaattactctttttaataatagccattctaactgggatgagattgtatctcattttggttttggttttaatttttttatttccataggtttttggggaacaggtggtatttggttacatgagtaggttctttagtggtgatttttgaggttttggttcacccatcagccaagcagtatgcactgaacccaatgtgtagtcttttatccctcacccccctcttccctttccctcaagtccccaaagtcaattatatcattcttatgcctttgcgtcctcataacttagctcctacttatgagtgagaacatatgatatttggttttccattcctgaattacttcacttagaataatagtctccagtttcatcgagttttctgtgaatgccattaattatttcctttttatggctgagtagtattccatcatatatatatgtaccacaatttctttatccactcgttgattgatgggcatttgggctggttccatatttttgcaattgtgaattgtgatgctataaacatacctgtgcatgtatctttttcgtataatgacttattttcctctgggtagatacccagtagtggatcaaatggtagctggatcaaatggtagttttacttttagtgcttagaggaatctccatactgttttggttttgatttgcacttccctgacgattagtgatgttgagcatttttcatatacctgtttgctatttgtatatctacttttgagaaacgtcttttcagatcatttgcccattttacaatacgattgttttttgatattgagttgtttaagttccttatgtattctagttattatttactttttttttttactggctgacccccctccccaatagaacatgtttcacaagagcaggggctttgtcattacactgctgtgttcctggagcctagaatagtgtttaaaatatagtcagtgtgctcaataaatattttttaaatgaatgattgcaggaattaagtaaaattttaatcaaataaaatttaggatttttctattggttttagtaataaatagaaaacttttgacaagtgaagtggtagtcactgctatattggatactgaggctttacaactgcatcatgtctgttagtaatggtcatctcttagctattttttaaaaaattttcatgtgggctaccagtctccagaatctctttctctccatgaactttatcattctctctcaaccgtgataatttatttctgtcaggggtatccatgatttcatattttaaatttctaatcttcgtttcttttttctctctgactcagtagtttgtgtgtgatagttgctctgtcatattttcaccagtaggtgccagtatttgatataacttatagagacagatctaccacttatggaggattgcctttccaggaaatgttctctctcttgtagataattcagaaagagcaaaccattctctctgcttgcagtaagcctgtattgaatcttctttacctacaaaaagatggcatgattggggggtgaacaaaaggctctgatagcattttttcacataaataaatgcaaatccatatggaatccttctgacggatatgtctacatactggaaaactttaaaagatgtatttcaatcaacctaaaagttaattatgccattccattcctcaaatattcaagaaagtcttccatgcatttgggctacacagcagcaaatccataatcatggttcccagcttgcatattagttttagtgttttgtttaaggctctctggttgggggaagagtttaatgtaagattaccttaaaccaaatcaagatactttcgagaacaaagggattcttatgagagactaaagcaggtaaacaaaggcagctccgactgataaaatacttgtttgaaggtgtgtggaggagatggtggtatgcaacttttaaaaactggcagggctaggtgtggtggctcactcctgtaatcccagaactttgggaggtcgaggcgggcggatcacaaggtcaggagatcaagaccatcctggccaacatagtgaagcctcgtctctactgaaaatacaaaaaaaaattagctgggtgtggtggtgcgcacctgtagtcccagctactcgggaggctggcaggagaattgctttaacccaggaggtggaggttgcagtgagccaagattgtaccattgcactccagcctgggtgacagaacaagactctgtctcaaaaacaaaacaaaacaaaacaaacaaaaaaactgacagaattcacagatactccttctgtcttatcgtgtacttgccctggattctactctatagcatcagtcaagccaccataacttttcttggaagtgaaaaaatggcctgaaaatatggctaatccccaagataactttaaaatactttcagaagtagtttcaaagaaaacacaatggaaatggtgaggttatacaggtctggctcaaaccttgtgtgagttgatatggaaaagaaaatttgattttattacttaaatattttacatgaattgcaaagaggaagtgaaggcattacatatatacctgtccagaatcattccctgatttcatgacatttccacatttgtatctacttgttcactgcccatgcatgggggctgtatcaagttttgggggtcctgcaccttatactatttaagtggttgccattaagaaaatggttacaaaataaatatctcacacattcaacctaactagtccccctttccagagaaggagctttctcatccattcactgcagtcccttacctaatacataccctcacaccgggggtcagcaagctactgctttgtgagccaagcctggatcaccacgtttttgtattagaacatagccacatccattcagttacagattgtctatgggtacctttgtcttacacttaccaagttgagtaactgccacagagaccacaaagccctgcaaagcctaaaatatttactctctggccaactacacaaactgtttaccaactcctgccttacacagtagctgtgggttctagccccacttctctctggatctacccaagagaatctaaaacaaccattcaccacatcataggattgtataagacatcaggttaatcaactggacaaaccctcgtgccttttgattttgtcttctaagaagtccaaaatcaaatttagtccttattataataactcatccctgattactggcacaattatttttccatttctcattaaattttattttttctttatcttagtccagtggtagtgactttttggtaagccatcttatttcttatccggaaggtggaatttaagtggtaagctaacatggtaaattattatcagtctgcctaattagtcatatgtgctttagaatatttaaagcaggactaaaagttgctatttttaaaaagctaccttggagtttgtgcttgtaactcccaaggtgaagacagaatttatcactgggatacctgagcttttgtgtacacaagaaaaataatattttaatgcatctcttagttatgcagaggcaaagcccagatcttacaatgcataaaaatgtaaaatgttgttttctttggagtaagactgcatctctggaggattattgtgctattaatgggcttttcacctgttttttcttccttaaagggagtgtgttgtaggcccaagagtttgagagagagcacaagacagaggtcactaatctgaggagataagggcttttcttctcagcaacaggatggcatgctgagtggctaaagaggaagggggtcaatatgagacctctgggaatgaataagacctgtgggctctagaaaactcagaacaggttttaaatctttccagattagtgtttaaattaccctctgtttaccacaaagcttcaataaagtttttaaaataatagcctactgtttattttgctttggtaaaagatgggcaaggctgtattatgctttgcatcaactattgttgagataagtagaagtgaagaaggtaccatgcagaggaaaacaaaagggaggggcagttacaaaatggataggggtggtctgaggaggattgaagaggtgatcctagcctgatctgagacaaatggccacctttgggaaacctcagaagcatttgaggaaattatttccttttgctaaatcaaaagagagatctcagaaagctggaatgccagagttgcttatgtaaagcactttgacaaatatgttattagatgactttagggttatgaatgagagacgtgaaaactataactgatttggttttcatccttctaaaaagaaaaaaatataataagaattcagaattcagtcaggctgcacagaggttaactgaaggaagttagctgaaaattaattggaattcggggtcgacttctagttaagtcaaatggaaccattaactttagggtaaaacctgaaaccaacaaagaccaatccctctcaaaaagatagagagtctcttgttttcatagcaaatgtataaaagggtaagggcacctattagggccttaccctagtagattctgtgtcctgacaacctgacccgtccgctgagatggtaaccctggtttaactagttggtaattccagtttgcttaagcattgagattgctatgttgagacagctggttatccttaaatattataatttacttttttattttaatagaaccccagatttttagctgggcacatgtgtgctcagaatcaagattatatttcctagccttctttatagccaagtttgaccatacgaatatgtttttgtcaaagggatataagaagtgatgtacaacatccagaagctatctctgaagagagaaaaagcctatctttattctttcccttttttcccttctttgtggctggagtatagataagatggctagaactggagtagtcatcattggcaatgaggtgacctatactagagcaacaagatagaaggagcctgggtccttgacatgatgaaactgccgtaccaatctgactgcctttctctagacttttacatcaggggaagtacatttttccttggtcagctacttttgcaggtgaatctcatcctgattaatttcgcacaaaatgctcagctcccttgaaatgaaaacattgtgtcttagttgttaagtttattttctacccatggaacatgaagaacaaacacagggtttgcatcagttatctctctctactataatgctgtgtaacaaccacaaaatctctgtgatgcaactcaaatttcctccatgtgtccctcatcctccagcaggatagcccaggtatggtctcatggcaatgatagaggaaaaagagaacaagtactttttcaagcctctagttgtctcatgtttgttaacatcacattttccaaaataagacatgtgcctggactcagaatcaaggggtaggaaaatatattgtctcttgataggaggaactgcagtcaattggcaaatggcatggatacagggaagggtaaagaatttacgtcattatttcaatcattctaaccttcatattaaagttttaaaaataagcttagaattaaattttgggataggttttcataataattgtaatactgtatccatttggtatttaatggttttgcaatatcagagagaatttggcatgttagagaatatgcaagacttagattatgattccaattccaaatgtaagattttgtcattgattttagtcttttgaatgatatttggaaagtgtgagataaatttactaagttagcaaacagtactgaaggcctaagagaagttcaggttcactaggtctcaagttgaatttttagattttctagcattaagttttgtgaaaatatcttatttggtactcttctgaaatgttagcccttctaaaaggctttccctgaccattcaataaaaagtgactatatcactttaccttctcttctatagagcatttatcagtatctggaatgataccatatacttgtttattacctactttacccactaaaatacagtctccacaaaggcaagcattttgttttgcttgctgctgtatccagaacacttataaaggagcttgatatatagtaggtgctccaaaatttgctgaatgactgaataaagctttggttttaggtcatggctttgaaatacttaaagagaaattttaatataataaatttatgaatgtaattcaaatcctgtaaattaattaactgaattataaacagggctaatagtttgaggagttcagtctgctcaatttgagttgactaaatattaattaaaggttttctagtcagtggctaatagtttaaggagttcagtctgctcaatttgagttgactaaatattaattaaaggttttctagtcagtcactgttaaaatttagtgtgtatagaaatagaataataggatttgcaaactggtcttaaagacttataggaaagctagcttgttaaatgttgttttagtaattgaatattatttttaaaagtaaattttaagaattaaaaaaataaagtaacaatactgattatttctgaattaaaaaactgtgcaaggacttaggaatcctcatactgtccacacgaagtctgtatgatgcacatatcgaggggcatggagcagtaaacagctgagtcccagagaaggagcgaggagacattatttactgggattgctgtcactgtggagaatgatgatggtgtaacacaggaaatgtaggggttggggtaaaatggagggggagccatctttactttaaagagatgggtaaaccttttcatgtcttcaaaactgaaattgacttctgtctctccaaaaaccccatgatgagtcaagacagagttgaggagagagaataaaggaatatttaggaggaattatggtagcattccttttataaatcaattgaaaaggagaacaaataaacaattttcaaaggcttaatgataaaggtacccactgagggtgttggaatagcagtaatggcagtcacaatgactctggttttcatcagagcagaatctcctgtttctggctttaattatctaccattttggctatattgtcacataacaaccacctcaaaaactagtggctaaaaataattattttattttgttcacaattttgtgggcaaagaatttgagaagggctcagcaggacaaatttctggttcagattgtatgagctagaaaagatgggactgcgaggttagcttccaagaagaatttttttacccacatgcctagtaccttagtgctctttgatctctcactctctacatgttgtatcattcttcagagcctctacgtgtagcttgagattctcacagcatgatggtctcggggtagttgcccttcttacaggatggctggcttccaagaggcagaaagtaggagttgccagggcagttatggcctacaagtggaactggagtagcattacttccactgactcagttggtcaaagcactcacaaggcctgcacagatttaaaggaggtggcgatatagactccactttttaatggtgcagtgtcaatgtcacattgagtgaaaatggcagagtaaggacctctgaaaattcactcctacataaaaataataagaacactgaaaaatggtcagaatcaacattttcagaactctggaaattaaccaaagggttgcgctaatctggggagcatttattcaagaacaatggctaaaactcattaagaactgcaaaaatttctggcattttaactttccatattcccatccccctctcttcagccccatggtagccttaaaaaaaccaatagcctacaatcagtgaaaaccagcatcctgacagccaccggaaagggtagaacagagttgaagcactctgcaacattccagagaattatcattatttgacctgtctgtggttccctgaaagatcactctcaaagctgtctttattttacctgacttggagcttgctcagtatgtaaagctttttcttcagagaatttgtcaaaaacaacagaggcaattgttgaaccttgaagctgcctgaggtggtacatagattgcaattgaggtagacaataggctaaacaaaaaacttaaatggaataactggaaaatgaaatgtccatgggggcttcaaaaattgtaacatgtttctggaaatctggagggccatgcacatatatagggctctttgcatgctcaagaaaaacctgagaagtctctaactttttatgtctgactaacctcaaggtgctctgcaaataggaagtaaaggctaagttggagttgtaaactctctgcctgagtgttgagggggtgcctcaacatgcactcagagaccctcaacaaagactaggagacttattggtttcagacatgtaaggaaatctcaatctaatcattagctaacagagtagagactccactggccacacatgacaagaaatacagatttcactgaattagtttagaaaagtcactaagcaatcaagaaaccctggggaggtaggagaaattgatttccagagttaccacattatattattttaaatgtccacttttaaattacgaggcatgcaaaagaacaagaaactatggcgtatccacaggaaaaatgagtcaatagaaactatctttgaggaagaccagttgctgaggttactgacttgaaatcagctattttataaagagctgaaggaaaccacatctaaagaactaaggaaaagcatagaacaatgtcttacaagtacagaacagaacatcaataaagagataaagtatttaaaaagaaacttgcaagttgaaaagttcaataactaaaataaaactttcagtcgaggtgttcaacagatttgggcaagcagaagaaagaattagtggacttgataatagactgattgagataatctaatctgaggagcagaaaaaaaaaagaaaaacatagcctaagagacctgtgggacaccagcaggcatactagcatattcataatgggagtcctaataggagaagagagagaaaagacagcagaaataatatttcttttttttttcttttttttttttgagatggagtcttgatctgttgcccaggctggagtgcagtggcacgatcttggcttatgcaacctctgcttcctgagttcaagtgattctcctgcctcaacctcccaagttgctgggactacaggcacccgccaccacaccctgttaatttttgtatttttagtagaggtggggtttcaccatgttggccaggctggtctcaaactcctgacctcaagtgatcagcctgccttggcctccctaagtgttgggattacaggcgtgagccacagcgcctggccgaatgcttcaaaataaaatggccaaaaacttcacaaattcaataaaagatatgaatctacacattcgagaatccctatgaattccaagttggataaactcaaagagatctacatttagacaaacaataatcaaactgtcatcatgaagagaaacctttgaaagcagcaatatcatcacagatcaggaatctccaataagattagcagcaggtttcttatcacaaaccaaggaggacagaaggcaaagtgttgatatatttgaagtgctaaaagaaagagactgtcaactaagacactaagacttctatatctatcaaaactatcattcaaaagtgaaggagaatttaaggcattccggataaataaaaacagacagaatttgtcactagcagacctgtccaacaggaaaaattagagagtctttcaggctaaaatgaaaggacaccaaactgctactcaaaaccatgtaaagaaataaagaacccaggtaaagataactacatagttaaacatatataaagtatagcataaatttattttttctttttaactgttttttctcctctttgatttaaaaggcaatttcataaggcaataattgtatgtctgtattgatgggcatgcaatgtttaatgctttaatttttatgacaatatctacacaaataagggtgcatagaatggagataaattggagcagtgttttttgtattatgttgtaattaaattggcatgaatttgagccagtttgttttaagttaagatgttaattgtcattgccagggcaactactaagaaaatatcttaaaaaaatacagtaaaagaaatgacaagagaattaaaaggtacaccagaaagtatctttttaacacaaaataaggcaataatggatgactaaaagaacaaaaaggcataaggcatataaaaaataaatttcaaaatggcagacacaaatcctgcttgacgagtaatcgcattaaatataagtgaattaaacagcataacggatttttaaaaatgatacaactgtatcctggccacaagagacatactttagattcaaagtcacaaatatgtcgaaagttaaaaatggaaaaagatataccatgcaaatagtaatcaaaagagagctggagaggctattctaatatcagacaaaatagactttaagacaaaattgttgctagagataaaggaatacatttaataataaacagtgtcaatccaacaagaagatatgaaaattataaacatatatgcacccacgaagagaacatcaaaacacatgaagcaaaaattgacagaaaaacgtatgtgatgggagatattgttgtggccatctttagaaaatataatctgccacatgcactagaaaaattacactatgtttagtattcacattatcttgttctagtaactctcatttagatatctgttatagaaattaatggactgattatccctcaaatctcaagatcatttattaagacttcacattagcatccagaggctgaggaggctgaggagttcatatgatacagctcatataattttaaaaagaaagtatccttttatctaggcttttcatcttttatatataagcctgccttcccctagaggtctagatataatgtattgatagccagctattgaggactgtaggtgattcactcacctccgacttctagaggcaaattcttatggtcaaccaggaagctgaggcttccttcattgaacatttagaatgcggttattcacccaacagttgatatagtccatgtcatactcataaattgttcccacaaggggacagtatatatcaaaacagactaggtgcagtggctcacgcctgtaatcccaacactttgggaggcagaggagagcagatcacctgaggttgggagttcgagaccagcctggccaacatggagaaaccctgtctctcttaaaaaaaaaaaaatacaaaaattagctgggcgtagtggcaagtgactgtaatctcaggtacttgggaggctgaggcaggagaattgcttgaacccgggaggcgaaggttgcagtgaaccgagatcatgccactgcactccagcctgggcaacagagcaagactgtctcaaaaaaaaaaaaaaaaagtacgttgacagatgtggtaggtacattttctagaaattctccccatgattccaggtcccaatccccaggacctgtgaaggtaattgggtatgaaatttgtgattgagtcttgactcatacattgagtcttgttacagctgtgttacttcataacacagttgtaaaggtaagctatcagggtatcgagtagcctaatctaaacacatgggcccttaaagtagagaattttctccaactgctggcagaagaagagggcagacgggaatgtcagagacattcaaaacgcaaggcggctttgattcaccaccattcctagctttgaagatgaaggggaccacatgaaaactgtggatggcctctacaagctgagggaggctgtcagctgccagtcagaaaaggaagggggacctcagtcctacaactgcaagaaatgaagtctgccaacaacttaaatgaactttaggttgaagcagattctcccccaaagcctcttgaaaagagctcagccagccaacatcttgtgaaactcagcagaaaatctagccacgtccacccagaattatggcctacacaactgtgaggtactaaatgagtgttcttacaaactgcttagtttatggtaatttgttacacatccatggcaaactaatacagtggatcaacagagtaccaatgtggaatccccattaattcttatctttcttcttcccatgatcacatgagtgagctacacagatgttgtatataaagcaaacatgaagatgtctatgacaagcgatgggcattgcaaattcagggatttccccaacacagacagaaagtctatggatttaatgattgttgcatatgtgatacaggttttattattgcttcaaaacattatgtttcattatggaagggggttgggctgtaatcctggctggaggatatatgaactaagaaaatattactacatagatgattgggggaatatgtgagaaatgaatacatgatatatgtgcacaatttcaactttatttttactgcagcagataatgataagatgtattttcactgagcctgcagaatttaaagggcttgtccagggagatttttgaatgtacaggtttggaaagttttcagaaaatgaatagagaaacttatctatggatgtcctttattgtccaatcttccgtcattgaaaataaccctttgtcaggcactggtgataactatcaaattgttagtcattctgtagccccactaaagtagaaaatctttctgctctcagatgctgcatctctctaatagtagcagcctaaccttgcaccttgacatgaatcaacttgtggctggctttaaaatacttaagcaaatgcttatttgcattgaatttttcatttctttatactatatctccttgttgttcataaagtcacatgctttaaaactttggtttgaatggaaaagaaacttaaagatacaaagagctgaggatgatccctaacccacaaaataagaattttccatctctgccattcattgtgtcattttgtcatattctctctctctgtctctctttctctctctcacccctcactcctttcctccttccttccctcttcagcctcctcccttgcccctgttttaaatatgtattcctatcccattgtaatgccaaaatgctttagactgagcacaaccctcacttgagctttttcccttttatcagctaagcttggaatttttcaaaggttagatatgattacttactgtgaaatactaagacagaccttctggcaattgttctttcatccaaatgaagggttgaactttcaaacagttcatttactaggtactgcacctattcaaatgagcctgcattaatacaaaaatttttgaaacaaagttgttgagattgtttgaaaaatggtcaggcgcggtggctcacacctgtaatcccagcactttgggaggccgaggcaggcagatcacctgaggtcgggagtttgagaccagactgaccaacatggagaaaccacgtctctactaaaaatacccaaaaaactagctgggcgtggtggcaggtgcttgtaatctcagctactcgggaggctgaggcaggagaatcacttgaacttggaaggcagaggttgcggtgagctgagatcgcaccattgcactccagcctaggcaacaagcaaaactccttctaaaaaaaaaagaaaaaaaaagaaaaaaaaagaaagataacccattccacaagaagaagatcagtttccttacaagcagattattgttttagtcacaaatttatacctaggcttaacttctttctatgttttagctttatctttattcttctatccttcctctgctgtgctggtgctgtggtagaaattatctagaggaagacctgtatagggcagcggcagggcctggcttaagatgagacctggagagtattgctaataattacaatgggaaatggaaaggctatcttagaatattttatgtgctattcattgtcatcctaggtgcactggctgagcgccatcaattatacacattaatgcaattagtcaagatacagaagcttgtattccaaatgaaaatttcctacatctgaggcatctgtgtaaaaggtaagatgtgctacatttccaaaactgtgtctaaaattctatttacaatgggttacgaactcaatacccctagaggcaaggcaggtagacaatgaggaaatggtgataactatgataaattgggtgtgtctgccctatctttttgtcttgttttgttttgagatagagtctccctctgttgcccaggctggagtgcagtggcgcaatcttggctcgctgcaaactctgcctgccaggttcaagcgattctcctgcctcagcctccttgaatagctgggactacaggcgtgcgccaccatgcccagctaatttttttttgtatttttagtagagatgaggtttcaccatgttggccaggcaggtctcgaactcttgacctaaggtgatccgcccgcctcagcctcctaaaatgctgggattataggtgtgagccacctcacctggctgtgtccaccctatcttaaggagagagccattctccaacctctgccttttgttgccacacagattctgagaccactgttgcctgatcctgattcttgaaagaggaagcagaaacatggattattttatttgaattcccctatatgtaaatgcttattcctttttcatacaaatgaaacataatagacaagacaaacaaaacactcctataggctggatttagccactggatcattaatatcaaggtgaccattaaaatcaagggttcccatgggagacggaacttgcagtgagccgagatcgcgccactgcactccagcctgggcgacagagcaagactccatctaaaaaaaaaaaaaaaaaatcaagggttcccagtgatctcgtttcccacattggttctctctcttttactaggtatacatgtttagtatacagacaagtattttcagttagggataggtgtgtatgtatatatatatatatatatatgtatataatttgtgcaaggatgttatcttttgcatgaaaatcaatctaggtgtatgaactgggcctgtaaaatttattggaagtcagtaataaataaatatgaccactgtgtttattttactgtcttctgattaaattttgtgttgactctggggtaaattatctgatatgctgcaatgggatatttccaggagacttatttggaaaacctgattagaacccagtagagggtaaatgacagagtccagtgaaagaaatcattcttggaggcagttgttttcactcttcatgactatttctagaaataagctttagggaaggatgttgcctaactagggcttactgtagagggattttcctgttcctactggcaatttatgtagttactatgaatcagtggtagaattagatgcatttgttgactgaatcaattggagtttctgtttgttttaaatcaggcatacaatatatcatgccttacaatgacaattaaatacagatttagaatcactggattattaaatgtaagtgtcataaggacaagtaaaatgcatcgacttcagggattccctgccagaaagtcatgcttactggattcattgcacagccgtatctgggacccgctccccaccacatccagcttgtgcagggacaatcccagaaagaaatgtaaagtggctgattacaattttggagtgtatttcctgagaccccttacccctttctgaccttgtaattcatcattgacgttaacataataatgatgattgaggtaataaagcctagatctttaacatatgaagttcagagaccatagcagaggctgctggtgccctaccatcccttccgtgttcacccggacatgcaaaaggctgcttgctgcaaaaacctgctactattactctctgtctgagggctttttttcccctgtggtcaaagaggcaagctctccttgtgtctaggataaggtccccagaagtagcctttaaccaatgactgatgggaagttgatggataaaaacaccccaacttctttgactgtcaaattatgtatctctaagacgtgactttgcatttccagcaagttcccatgtgatgcttatcctgctggccagggactacactgtgagagccactgtactaaagacattgaaccacatcaaggactgaagcattttaggatttgatcacgtgttcttttcatagaataattttctaaaatctatttttacttatgcctcctacccacggaagtcaattacttgaaataacttgtagggaaaaaaaaacttttcatttatattttatcttagccattcccttactgtgattttgattttcttgctgtcagggttaaccgttttggtaggcctaaactaccattaaaagtcgttagtggtataaattttctaataattcagaaaaattctattgtattatttgtgaatctaattgagttaatgagttttattctacaaataatatttataataataggtctttcataaacataagcacaaattctttcattagtacatttttcctgtatgtcaacattttaaataaagtacatatgtgaattttatggcattttttcatttgtgatcatatatttctttaagggaaatagcacatcacttcagattcctgttaattttacctgctgtcatctcctacttaaatgagtcatgtcaagtattacgtgctgcttctcctgacaagtacctgaaagttggagcaattttcacacactctgtcctattcttctgtcatagttcttcaatgcattatgggcaggaaatgactttgactgatgagaagagttagtgggaggatgttcaaatcaaatggcacttatccttgccctccacccccttatctctaagaactccccacagatggcttacgttgtcctgggctggtttatggtatagcaccattctctgctaagctcttgaacaccagctcatctgcttaattccaggtcttctctatccgttctgggctctcctatcctcttccccattgctgtgcttcacttctcccttttttcaaataaaactaacatatggcttttgtgtgtggccgatttctaaatcttggaaataacagggaagggaaaaaatggtgacaacccagcccagtaccacaaacttacaacagaatatcatgccaccatgttctcagttctttagctatgcccgatcacagagaatttctcctcaggcctccatattgcttatatctttgcctcttcctctttctgtcccctgctttcatcccttcctcccttcttgctggcctcccttctggccaccttagtctctcttactctgtttcatggtgtaatttggctctcattcatttaaaatttgagcaagggtcctcacatttctctatgaacaagtcagtcaaggcccatcatcaaagtatttttctaaacaaaagagctatctacctctgagaagatttgaatcattcccctagagaggatgaagtgaccatagtcagtattgttttaagtaccattttaaattctcactacatttgttaaagggaagacaatagggaggcttactgctgagagtatttttgtgaattgacacaggtttggaaaggaaaactaaggtgaattaggaagtgcattgctggcttatgttaaagaagaaaatgtttaaggactcttgctaaagatggtaatgaaggctttatttggggagactattggctataggtagaggaaccactgcaatgaggtcttgaaatgggggaaggagactgggcttaactctgactccaataaggccaagtggggatttacaaccaaggagcaggttgagggtcagtgggtggaaaattactaaaaggaaacctcagggtaagggtgactcttactagaccaactcaacataactcctgctgaaggctggccagggtgatttgatatcgaggatgggggatgagaaatttgattatacaaagtgtgggggattttcagtaaactaacttagccccattcttgcttatacttgattctacagggacaaagaggggagcccaaggtcggaactaggttaaaggagggagtctttgttacttagaagtcagattcctcgttttagctctgcttctgtctggcagtgtggtctttaacaagccacttaatgtctcccagcctgtgtttcatttgtaaatcgagagaatttgttctgtgtctttcaagctgaagcataagcctaaacaaaacaaacaaaaattcaccatggctcctgttgaagcaagggaggagtccagacctacccctttatttttttctctcccatggcctcatcggcagagttctgaacacactaatctagatgattttcataaacaattgttccctgcttttctggagctttttatcaaaattcagtttactataaatgctccttatatgtcaagcagaagcctctcaggtggaagcctgagaaaggaacttcccatggcctgacatagctgaggaattttggagcatagtcgtttcatgtttatttatggattgtttatggccctaggctaagctataaccaaatcttcttactcaccatcctatgtattcttaatatttaaaagtctatcacaggtctggtctgttttggaaatgatgtacctgttgaaaaagatttttttttttctgggaaaagagtctgggggcattttgattgagatttgacatttggcaataattgatgagtatgttttttatcttaaaatgcctgtgtaattgataatatacttaaagaaatctattacattagcaggtgattccatgaagaaggcagaaatcacttaaacctctatagcaggaatttgtgacataccacaaaactgccccaaccccttgggaacttgatttccattcacttgtggagatgagtcccctgcacttgccagacacccatgccaagtgggcagtggggcaaaaaatggagggtcattccatgaatgcgggcacaactgaaagtaagttaacacctccagagacaatccttagccaatggtgagtaggagtaggtagaataatgccccagccactcctacctttgatggtataattttgaagagcattgtgtgcagttcttcacagtatccttaaggagactgagtctcatttttctatagaagtagaatacatttgattttttcttcctttctctgtctcactttctctatctctcacttttgcatcctgggattacctcataaatacttatctgcctccaagtccttgcctcagggtctacttttgggggaacccaaattaaactaacttccaaagctggtacaacttcctatactaataattaaatagatggtcgactgatttcaaagcaaagcttttgcattctgcaactactcttaactttacatatatgttattgtttcaataaattgtactgtgttcttgagaatacaatctgaagcaaagcagagatataggtatagtaattctatttttacaagaattataaattgagataactgtgaattatatgattttagaatttaccttttcagctttcatggagcaagtttgttgagggtttttaattcagtaagaagaaaaatatgatgtggttttatttttttctgttaactgtcccccaactgtgtcaacacccctttcccaaagatttgatactaactttatgacatcttagtcagatttcatgactctcatcttactttgtattcctggaaataatcattttatttcagaaaattattttctcctcagtgggatgggagggaataatcagtctccatgaacagcgcccaaaagactggtgacttttccaccttctgcatagttctccagtcttgatgggaaagcagggtggtgttggttgatgataagggtgacactgtcctggcaccttccaatagacctgatctccactgttggtggctcactgaagactcaatgaacttagagcgtgtcttcaaattgggccttaaaattccatctgcatcctgttgtggtatgtttacttaatcttaacagtaaacaaatttgtacttcctgagttcgcatcagcaagtctgttgttagaagtcagtttgagttttagaaatttattaggtatgatttactcatgagtaaatgagagttggctaaaacaggtggaatgacaaaatcagaagcatcaaaaatcatggctacagtcaccttatgactatccagaattagaaggctctatgcagagatttgagaaatggcaacaaatgaaagtgccagcatctgtagttcagcatttgtagctgtggagtatgtagattcacttttacctgacagtcctctgcaagaaccattttaaaatgcttggaattgtatgttaataattatacaatgttctagattgcaacatggggatctgctattgttcatgaaaacttttatttcttgttctttttacctgggtttctatttcaatttataccttgcattaaaaagaataacattgaaaaatataaaccagagacataggaaaaccaacggaagtgctttaaattacttctctttaatcacttttgtatccagctgcttttatgtgtggaacctattattttacagagtatttcaatattctttatgattgaaaaagaatgacaaaatggtatatgcttttggtaaggtgctttggctatactacagtctttgatactacttggcactatttctaagcctgcatagattcttttaccacaaaaagaatatgtaaatagattcataaaattcatcatgagtttcaagctccatttggaatagaagctgaatatgcacatcctttggaaattctaattcttggaactggatttttcattggaatcatgcttttgtgttaccatgtaattaattcttctttggacatgggtgacaatttatttgatagaaactattgatgcccatcgtggttatgatattcctctcaaacctttaaatctcatccttttctatgctggttctcagcatcatgatttacaccacataaacttcatcagaaagtatgcttctacattttcatggtggaatacaatttttcgaacacactttcagtttaatgtttatagtgaaaatatgaagaagtttgagaaaaagctgaataaatatctcatataaacctttctgaagatatacattttcctgaattgaaactagtagctaacattgcttctggggagcagaaataagcatgtgtcttggttgctaagtgataaaaggaatattgataacctctaattatcttcctagtggagactttttctactttacacacagattccgtatatgtaggaatacatggataataagtatttcctgcaaaactggtcccctcttcatcacctcattgccttactctctctcttgccccactttcttctctccctcatttcctcctctccttaaactttcctctttcattcactgtcccttatttctccctcacttctgaggggccaaattgattgtcttcatattataaggctcacccttttcttgataatctctggtcaatcagcttcattcagtgattgctttgtgaacattcctgtgcatcataagacatttcctatttccatctgatatggtttggctctgtgtccctaccaaaatctcacctcaaattgtaatccccacgtgtcggaggagggacatggtgggaggtgattggatcatggcggaagtttccctcatgctgttctcgtgatattgagtgagttctcacaagaactgatggtttaaaaggatgtggctttctttgctctctctatctctcctgccaccatgtaagacatgccttgcttccccttcaccctctgccatgattgtaagtttcctgatgcctccccagccatgcggaactgtgagtcatgtaaacctctttcctttataaattacacagtctcaggtacttctttatagcagtgtgaaaatggactaatacaccatcagaaaactgatatcattttagctaagatttacatctttttgggcgctgtgttctggccactctttctctgttgggtaaaagaaatagaaactgcatagatttggcagacagactttggtgtagatcctaattttcccactttgtaagtttggctaagctagttatttttttccatattcagtttcctcacattaagtgaggctaataatagccaccttgaaggatttttgtgagattaaataagatgaactatttgattatttgttaacatcttaatttgaaaacattttctcctgtgcctccccaactccatttcatatttcttttcctgatgtttttatacatttccaaacaaaaccaaagtaccaaatgactcagtcaatttaagcccaaatacacagagttccaaatcttcttcatagcttcattgtttcagtatgagaatatttcttaagtgggcaaattctactccaggaggcttcagaatggtcaggaactttttttcttattttcttacacttatttcatttagatcctgcataattcctcccaagtttatcctattaccaagcagtctaatggacaataatgacagggaaccttatataacagagtagtaaaggttaatgacaacaagaggtataacatgagctgcttttatttactaggaatattagttgttctagaatttaaagtccaaaagcatcactggaatcaattttctaagcattagttttatgttttatttttaaaaataaaaaagcatatatcatttcaaggaatattattatatgttattataaaattatatattatattatgaaatcatttacataatttttgcttaaattattttttgcaactttattgaagtatagatgatggttagaatttatatatttacatatatttttatatatatttagagtatacaacttgatgatttgatatatgtatacattgccactttccccatctgccaccacctccccgcctcagcctctggtaactaccaagctactttctatgttcaactgttttagattccacatataagtgagatcatggatgtttgcctttctaggcctggcttatgtcacttaacataatgttctccaggttcctccatattgtcacaaatgacaggatttccttcttttttatggctgaatagtattccattttgtttatgtaccacattttttaaattcatccattgacagacacttagtttcgctattgtgaataatgctgcagtgaacataggaatacagatatctaagggggagagattttaaaacaaactgagcctcaatttgttgctatttcttttctgtatgtaaactctaaaggttcctattcaatttcagtcatgttatctgatatggtagccattcacattggaatctaaaaatcatttccaacccgtttcttctcttgtccacctctaccatggaggctgaaaaaacctgagactcactttcctattctcccctgccaatgagatataagggaagttattatggggcttcatggaaagtttgtactttctaataaaaggaacaaggtacataaatggcttgtctcagtctaatttctatgaattcctgcctttaaatgctactttgttattgtgatacttgcagctaggaagagcatcttgaaaccatgaagcaaccattcaaagaacaaaatcccatatgctaaggatggtcaaacataacagcagaaaaagcctatgtccttcatgacatgggtgagccaccaaaccaacctgacattgaggtacctccaatggtttatatcattgcagtttgtttattattgttgttgttattcatattgctattgcttgctgcccaaagcattcctcattgattaaatctggaaagagtaagctatcatgccattagtgcttccaccttaatcagcttaatttcttacacctcacaagatctgagaagaacaggtacattttgattgtggttagagggtagaacatgaaaaaaggaaaaaataaataatgttcaccataatgagggaagcttatttggcaccaaggaagacaaaaaaggaaaatatacactagttagggaaaataaaaggaaatgtagagtacatgttttgcccttttagttgcacctgggtgcccagttgaccctgggtacaacatttaaaaaaagttgtgtttaatttgtaattatatgctgtttaacattataattgcatgtgaaccatgacaaattattaattccactctagatctctcctgtcatatagacagtggtttgaatgcttaggacatggaaatcaatttcttgactggtctaaggtacacatcattagaaaagaatacctgttgcaaaaaatttttaaatgtgagtgatttgtatcctttgttgttttggactattcatgctcccagcccttttccgtattttatgaagtctttaatcaatacctatttaaatctttgaggaatgccatcatgatcaaattggaacttcaagaagtttgaaagattttctctcaatagattgagtcactgcctttcacctgttttcctacttaaggaaatataaattatgtatttaaacatcctcttgctcttagatatggtatatatgcttctgggaccctttctgttggcacctgttcctctactctacagtatttctcacttagaggaaacctaataaatgtatatctaaaagatattgctctattgtgcatatatattttatgaaataattatttgctgaaagtattttcagaagagctgttttaggtaggaagattttcaaataccatttgataacttatatgtgaattactacctttcagaaataataactgtaaagcaggatatatctttatttacttttacttttccgaaggtttgatatatgctttcagtcttcagaacctgtacttggaattctgtttataaccgagaagtatgcaatgctttcctatttaagaaactcaaaccagcgtattgcttttttggtggctttaatattggttgaaattacctttaatgtatgatgtatattcagttggttgttatagaaaatattattcattaacagttttattataaaagacagtaattgaaaatacaccaaatattgatttttgaccaaattaaataagttctttttctgagagcttttcaggctatgaaagtataaagatgtttggaaacatatcttgatatgtgttcattttaaggtatactgaagtttttcaattgttaatcagtgcagcacatgatgggtgttatccatccaacatgtaatacaattttacttttatagcaattaccgaaattgactgaagagcctgagtagaacaataatcatggaagaaattggaatatgtgtaaattgatctgatctgaagggcagaaagacttacgaggaataaaaaaaaaaaagttatggatccataaagtaaaagaatttttttttcaaagtttagttcactattatataccaaagaaaagtgccatctgactaagaagccctgttctattaaattcttactaaatatctgtttctatgtggaaataaatgctaaactccattatcttgctttcatattactaacattagatttgttaaaagatcctcggtaaataagtgaattgatttcaatggtgattttttgaatcacatgtattaatagcaagaaaaatatattatttgggattaggaacagaaaatatcaaaagcattttaataaacggtataaatatgttttatgagtttttttaaaaaaatcagtcattcattcatttactcactaagtatttactaagcatgccgtatgtgtcaggttctgccctagggtggcggattccaattaaagcatgagtaagacagtctcacctcaaaaagacagtaggagagatagactgataggtcattatactgtggtaagtacatataaatatgtacagcaaattgtgaggagcaaggaggagaaaaccataaactgggttaaggagaggcccagggattgctttctggagaggttttgaggaactacaagcagtgttgctgtagtaaaaattgtaaggcaggagtggtgagggatgagtctaaagagttagctagggccagaccttgagggtcttgcttggaagttagactttattctgtggatggtggaaacccattaaagaagttttaacaaagtggagaaggaatacaatggggagaaatggtcaaatttccttagagaaaggtcctttggtggatacatggatcatattcttgaggaggatgggctagacacaaggagaccaggcaaatctattgcagtaatccaggatcaaagatatgagggtttgaatcagagcagtggcaaaagaaatacagagggggctctgaattcaagaaatgtttggaatatagatttgtaagatctaggaattgttggaatgtaaaggtcagggtgaggagggaaaatcaaggatatctttaggcttctcttttgggtgaattcagtattactaactaaaatagagaggggagttatgtcaataagctattgttccattaaaaagtacaggaaaattaactggcttaaaacaacaataatttattcttcttcacgcttctgctacttgattgagagttaactcttctgcacttgggtttgtctagccctgggtttgtctgcacttagctccagatggtagacagggtccaatttttgctgaccttactcttgtctttattagacttatgggctagccaagaaatgttctttccatgacaaggtcaaaagcacaagaactgaagttgccaaactcctacttgagttacacctgtggttatactgaccgaagcaaatcacgtggataagcccaaagtcaaagggtagggaagtatactccatctctagtggaaggaacttcaatgtcattagcaaaggtaactggggtaaggagagggccagggattgctttctggagaggacactaagaggatggacactaggagggatgaagaatttgggccaataattcaacacccttattgttattgtgagtgatagatttgaggggaagaagactggaggttaagaggctatttcaaagatggtaaaagtccagagcagtggcagctggaaaagagagaaaatgatagattcaagaagtattcaaggcctggacattgttataacatggaggacagatttaggggaaagagtcaaggatgactctaggcttccaatttgactgactgagatatggaaagaaggatagtgggttcagtgtaggaaacattgagtctgagagagagtgacaaagaattttatcgtcaaaaccagggcacttcagagaacgtgaaagagtgctattaataattacgccagaaccaccagggtaaacatgtcttgggactgatctcaggaaaacgagtttatattcactctggagcgagttgcctttgggtaatcaaagtgaagttattgagcatcagagaaagactctgtctaaaaaataaataaattaatttaaaaaagtgaaattatttagtataatgttgatatttgagtatgaaattcagtggagagaactggtctggtgatatagacttgggagttatcattcatagtttaaagtttgaaagcatgagtctggttgaaatcatcaaaggaagcatatgcaggatgaaatgaatataatagaatgagaagatgttgctggagtagatgacagatgaggaacttgagaaggaaaagtcaacaaataagaatttgatttaagccaaagagtagaatttaatggacaaaataatcatatgagaacactcagggtcagagctggctttgagtatgactaaagttagaaattttaacaccatctttttttccctcagactctctgtttttttgttttgttttgtttttaagctgagtgactctttgaggctagagtcatgatcttaggcagttccagattcatattctattagctccaaaaccagaaaaaaaaaggagttttttccttgttatctcaaaatacaaaataaacctgagggaagactctaattggtcaggtataagtcacatgcccatccctctactaatcaccatggctagagagttggggacccccacattagtgaagatgcaggagagcagtgggggtaaaagtcagattacagcaacttgagaagtgactgagaggtggtttggatgcagcaagtacagataagcattttaataaatttattataataaatatgaagaagagacaaactatacagtagactacatgaagggcaatgcgtatgtattttagatttgtttataggctgagataaaggaatcagtgaaacttgagatattcaagttaaagaaaaaaagagaatgcttgttggaacaagatcatggagcaagtctgaggagatgagatttaggacaaaaaaatgaaagaatgtagatttgaaaagggaaaagaacatctagtcctctgaacctatgatgaggtacagctaagtgtggacatcagtaagttaatggaagggcagtatattgagagagccaaggctaagagggagggcatcagggcctgagtaatttcagaagagcattgaaaagtcattgagggcactggcttcaggaactgactgaaggtaaggaaaagaattcacaggtgattaggcttagctgatttgtggaccacgagtttgtcttctcacccagtctgtagggctgtgtgatttttctctagctgtcctggatatgggcatgaagaaggtaaattgatctagggttggtgctttgatgagttcacgtaaatggggacaagatgctctcctcaaggaaacatacagctttagaggcaaatacaaggtcttaaagataagtaagcaagaacaagaagggaactttacttatttctggcattctgacatggtaatggtagacctctctatgaaataacatttctaattgacctttgctttcaatttctgttgtgatgagaagtttataactcttggaccatgctggagtaaatcaaaacataacagatgtttcacaatttgcaaaactgatttaattgtgttttatgttgtattatatttctgatagttataactttcctccccatctttcaccacacacgtacgcacacacatacacgcacaaatggacatatagcaacatcgtgtgcaaagctcttttggtgtcactatgaagctatggtgagttaacataatcagaacataatttcaggtctctaagtttcaattccagtatgccatatgaagaaaaaatattatcaaaaatagaacaacttttatataacttttatttaatgataccaaaattcttagaggtcattgcaacaaagtcttatcaatagcaggaaatattttgcagcatactgtaaagaacactggatctttttaccactaacgagatacgagatccagggcaaatgagttttctcatatctgtaaaattagggttatggtcccttcttgtatacctcacaatgtggttataaaaaaatcagagaggatgtggcaaaaagtgttttataaataataaatgagattataatttattgatcaatttttttaacattacatttatattcatttggtaccacagcatggattatttaaaaactgatgattacacattggtctctttccagggaacttagaggaatggtttaaattggttgcctattatatgtaagtttgtttaaaaatatctaaattatttatgcttctttcaatttatgtaatagattttaagagtccaaagatgatgactcaaactatttactttgttttactgtgtttgcaaaatgagtgaggtaaaagactggaattatctgccaacatcgtctgtattgtgttatgctagaaacatataattagatgaacattttttacttatttttgttcttaaggttaagagacgacagccttttctgactggggaaaatgctcacatctttttagttgagactcacccttatgtagcaatacactggccgggaaatgtaaagaaagttctaggttttaagtaattaaatttatgattatctttccctaaaggactctgtgaattggctcaatagctatttcctacctcaggattcaagttccatgttgggctttggtaaggactccttcactcctacttctagactgagtcccaagcttccaacctgagcatttgtatcatctggggcttcttaggcatcaccacaaagtgatcatgagaggaacaggagacaaatgcagaccttagtcatttacttatggcctgttttccatggtggaccaagttgaaattgaacacacccatatacaaacatccatactgtattgattctcctaagccaactctactggttgaactgtgtgggaaagatacaaaatgtaactacatggactaatcttgcaattccaagctaaacaattatttagcatatagtctcagtttaagatgcaaaagcagaaactattgtggccagagattttagaattctacatctatacttgtacttcactttgcctagttgctggttcttgtctatgctcagtgtaatttggggcactttactgaaaaatctgtacttaaatcaagtcatttaattaattagataattaatttagttcatttttattttggtgagaacatttaacatgagatctaccctctctacaaatttttaaatgtacaatgaagtgttatttactataggcacaacgttgtacagcagatttctagaacttaatcatcttgcataagtgaaactttgtaccgattgaatagcaagtgcccatttccccctgccagtccctggcaactgccactctaatttctgcttctgtgatttcactatttcagatactttatataagtaaaataatgcattatttgttcttctataactggcttattccacttagcataacgtccacaaagttcatctatgttatctcatgtggcaggatttcatgattttttaataatgaataatattcaattgtatttatataccgtattttttatctatttatctctagttggacatttaggttgtttacatatcatggctattgtgaataatgctgctatgagcatgggagcgcagatatgccttcgggatccatatttctatttaataccagtaaatacccagaagtgggattgctggatcatttggtaattctattttaaattttctgaggaacctccgtattgttttttatagcagatccaccattctacagtcccactaacactgtaccagggttgcaatttcatcacatcttcaccaacacttgatatctttcctttttatcttagccattctaagaggtatgaggtgatatctcattgtggttttgatttacatttccctgattattagtgatgctgaacatctttttatatgcctcatggccattcgtatgtcttgttgggagaaacgtcgattcacagtttttgctcactttttaaatttggttgtttttctgctactgagctgtaggaaacctttatatatttgtatattcgccccttatcagatatatagttcgcaattttttttctcattctgtaggttgccttttatctgttgtttccttttctgtgtagaagctttttggtttgatatagtcccctttgtctattttttgcttttgttgcctgtgcttttgaggctacagccaagaaatcattgccaagaaccaacattatgaagctttccctgctgtgttttctgctaagagttttaaagttcaggtcttacacttaagtctttaactcatttttagtgaatttttgtgtgtggtgtatggcatgggtagaatttcatacttttgcaagtgaatgtccaatcttcccagcatcatttactgagaggactctttcccagttgagtgttcttggcacccttcgtgaaggtctgttgactacatgtatgggtttaattctgggctttccattctgttccattggttgtataggtctgtctttatgccagtatcatactactgggttactgtagttttgtaatacattttgaaatagtgaagtatgatgcctctaactttttttaaacaagattgttttggctattctgggtattttgtggttccatatgattttaggattttttctatttctgtaaataatgccatttgaattttgatagaaatttcactgaatctgtagattgctttaggtagtataggtattttaacaatatcaactcttagtcaattttctgttgctatcacagaataccatagactgtgactgggcgtggtggctcacgcctgtaatcccagcactttgggaggccaatgcaggcagatcacttgaggtcaggagatcgagaccagcctggccaacatggtgaaacctcggatctactaaaaatacaaaaattagccaggtggagtagtgggcacctgtaatcccagctactcaggaggctggggcaggataattgcttgagcctgggaggcgaaggttacagtgagctgagatcgtgccactgcactacaacctgggcaacagaatgagactccatctcaaaaaaaaaaaaacaaaaaaaacccagactgtgtaatttataaagtttatttacctcatagttctagaggttaggaagtctgagagcatggtaccagcatctgctaatagccttctggctgtgtcataatatggtggaggacatcttatggcaagagggaagagtgtgtcagctcagatcactcttcctcttctcatagagcctccagtaccatcatgggggccctagcttgatgaccttatttaattctaattacctttcaaagaccccatctccaaatcccattaacatatggatttggggattaagtttccaacacacacacgacatttaggggacaccatcgaaccatagcattctgcccctggcccccaaattttattttcttttcacatgcaaaatgtattaattccattccagtagccccagagtcgtaacttgtttcaggatcaactcagaagtccaaagtccagagtctcatctgaatcagatatagatgagactcaaaatgtgcaatttccttgccagctgcaagcccgtgagatcaaaacaagctatgtatttgcaaaatgcaatgctaagcacaggatagtcattcctattaaagatggagaaaataagcaagaaaaaataagtagctggtcttagcacgtcaaaaccccaacagggaaacaacattaaaccttaaagcttagaatgatctttcactccatgtgccatctctggaatgtactggcgtgggagggggggttggaatcttcaaagccttgggcagttccatccctgtggctttgctgtgctcagcccatgcagcagtttatacaggttggagtcttatgcctgcagttctcccaaggggactgaatacttgtagatctacaattctgaattcttgtgggtagtccttcccctgcagctccactaggcattgccctagtggggactctccgtgacagctctagcactgactgaggtgtggctcctcacaagagggcattagctatggggatctgcccgcagaccctgacctaaacgacggatgaataaaacgtacactgacacacagatattctgttttgccagtcctgctgactgtccgaccacctgcacaccaagagaggtttgtcattgcggccggccctgagcagctcgcactccaggcatttatttagtacagaattaacaacagaagctttgagtaaacacacttgtggataattaacatggttaagagagtagttctactaatgattaaagctcaggtaccgcggtttaaagtaaataccattagggggcaatagccttggtcaaccttcccccatgagggccatctggctcaaaggttagttattggaggtagggtaaacagacttaaatgaggaagactctgttgtccctagtatttaccttatgacctaattctctaatgtaagaaccggctgccttcagcctgttcaattattacaagctatgtaagctttcggccttccaaacggtttgtgactattccctataactttccctaatatgtccctttaatatttctgccaccatcctgagtgaatcccaacaactgaccttacatttctgctcagcattgcccttgtagcggctctctgctgtggctctaccctgtgacaactctctgcctgggcctccaggctgttcatgccatcctttgaaatctgggtgaaggatgttcccacagctcttacattctgcacatctccagaattagcacttcatggatgctgccaaagtttatgtctcataccgtttagagtggtaggtcaagttgcacctggagcatcttgtgccacagctgttatgatgaggagtgctgcaccagaatgcaaggaacagagacccaaggcagccctggccagtggcccatccctcaaaaccattctaccctcccagagctctgagcctgtaatgggaggggaagactcgaagatctccaagagtttttctcctgatgtcccgatagtctctggctttgttttatccatactaatctccttatcaattgatcacttagtcacacccttggtttcctgtgctgaaaatgctctttcattctctaccacatgtccaaaatcatttcactctgctttcattttaattacaaattctctcttcaaatcatctctttcctcttttgttttactataagctgttaaaagtagccttgaaacatcctgaatgctttgctgctttcgtatatgttccacaagctattccagttcatcactcttaaattctgccttccataaagcattcaaccatgaacatagttcagccaagatttttgctactttataacaagaatggccttttctccagtttctttagttccatatgatacctcattagagtggcttttactgtccgtatttttatcaatattttggtcaaggccacttaagcaatctctaaaatgttttagaatttctctggtcttctcctttttctgagccctcaccagagtcactgttaatgcaccatttatggcaatgcaggtatttttttttcctagtctgttcctccagattatttttatttatttatttatttatttatttatttatttatttatttatttgagatggagtctcactctgtcgcccaggctggagtgcagtggcgcaatctcggctcactgcaagctccacctcccgggttcacgccattctcctgcctcagcctcctgagtagctgggactacaggcgcctgccaccacgcccagctaatttttttgtatttttagtagagacggggtttcaccgtggtctcgatctcctgacctcatgatccacctgcctcggcctcccaaagtgctgggattacgggtgtgagccaccgcgcccggcctcctccagattcttacagcctctacccatcacccaattccaaagctgtttccatattttcagatctctgttatagcaatggcctcacttcttgttgccaattttctaccttaagtgcattttccattgctatggcagaataccatagactgggtaatttataaagaaaagaagtttatttagttcatggttctggagtctgagaagtccaagagcatggcatcgacatctggcaaggtcctttttgcttcatcataacatggcaaaaagcatcatgtgacaagagggcaaatgtgtgttacctctcttcctctttttttttttttgttaactagtttctaaattgttatttatttttatttgtaacaagccatttacttaagtttatgtaaagggatagtttatgcttaaaggatagcagaggttgttgctgttctatttagcgtatagcaaacatggccagattttacttttgaacttcctggaagctcttcattggaccttgagctaacacaatatatcttttgtcaccaaaagagtattattcttatgtcataatgagaacaataatttacatgctttgcataataaatgcctaaaagacattttattttatgactgcattatttttcttgctataatggggatattgtaaatcatatatttgtataatattgatggtacttatttattttttatatgttactgtatgatgtacattacaaaatcaaagcaatttgtcttgatctcttaatcttaagagtaacactttaactcacttaatctttctaatgcatattacaagtgatgtatacttttttttgaagttacatacttgccaatttaatttcaaagctacaaaccaagctcaagtctcaagtgcagcaaatgcctctgaaatgaggtttctatggattcataaacataaaacaatcagtgcaaaagaataattgaaatgatttgtctcctacttttttttttcttgtcccaagcatttttttttaattatactttaagttctagggtacatgtgcacaatgtgcaggtttgttacatatgtatacatgtgccatgttggtgtgctgcacccattaactcgtcatttacattaggtatatctcctaatgctatccctccccgctcccccgaccccacgacaggccccggtgtgtgatgttccccttcctgtgtccaagtgttctcattgttcatttcctacctatgagtgagaacatgcagtgtttgttttttttgtccctgcgatagtttgctgagaatgatggtttccaacttcatccatgtccctacaaaggacatgaactcatcttttttatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtgtatacccagtaatgggatggctgggtcaaatggtatttctagttctagatccttgaggaatcaccacactgtcttccacaatggttgaactggtttacagtcctatcaacagtgtcaaagtgttcctatttctccacatcctctccagcacctgttgtttcctgactttttaatgatcaccattctaactggtgcaagatggtatctcattgtggttttgattacccctcttcctcttttaataaagcctccagtacaatcagggaggctccactttaatgaccttctctagtcctaattacgtcccaaaggcgccacctccaaatactatcaacatacaaaattggggattaaatttccaacacatgaaattttggggacacattcaaaccatagcaggtaatatggacattttaacaatattcactccttcaatccattaacatgacatgtctttccatttatttgtgtttcctttaatttcttcatctgtgttttgtattttttggtgtataagttttttatttcttagtattttaagtattttaaatgtttatttaaaacttaagtttatttctaagtattttattcaccttgatgctattgtaaatgggattgttttcttaatttccttttcagaaaatatatggttggtatattaatatacaacaaatccttgtatgttgattttgtttttgtttttgtgggtttttttttttttttttgagacggagtctcactctatctcccaggctggagtgcagtggcgtgatctcagctcactgcaacctctgcctcttgggttcaagtgattcgcctgcctcagcctcctgaatagctgggactacaggcatgtgccaacacgcccggcttattttttgtatttttagtagagacggggtttcaccatgttggtcaggctggtgtcggtctcctgacctcatgatccgcctgccccggcttcccaaagtgctgggattaaggtgtgagccaccatactcggccttgattttgtatttttaaactttactaatttttaaattagttctgtttattctggagtatttagggttttctacacggaagatcatgttacctgcaaagagattttatatctttctttcctatttgaatgccttttatttattttccttgcctaattgcttttgctaggattccagtactatgttgaatagaagttgtgagagtgggcattcttgccttgctcctaatcttagaagaaaagccttcagttttttattattgaatgtgatgttagttttgtttattatgttgaggtaatttatccttattcctagtttgttgagtgtttttatcatgatatggggtattacattttgtcaaatgctttttttattacatctgttgagacgatcatgtgatttttatcctttattctgtcaatgcagtgctatgctctgaatgtttgtgtgcctccccctatttctatgttgaaacttaatcaccaatatgatagtatcagaagatagggcctttgggaagcaattaggtcatgagggcagagctcttaggaatggggttagtgcccttacaaaagaggacccaaagagctcccttgccccttccattatgcaaagacacagatagaagacaccatctatgatccagagagcagaccttcactagacaaaaaatctgcctgggccttgatcttgaatttctcaccctctagaactgtgagaaataaatttctgttgtttataagccaaccagcttatgttcttttgttataacagcttgcacagacttaggtaggtggtgtgtatcacatttattgatttgcatatgttgaaccatccttacatcccagggataaatctcacttggtaatggtacgtgattcttttaatgtgctattgaattctgcttgataatattttgttcaggatttttgcatctatattcttcaggaatattggcctgtaattttctttcctttaggtatctttggttttggttatcaggttaatgctggcctcataaaattagttggttaatgttccttcctcttcaatttttcagaagactttgagaattattggtttgaattcttcttcaaatgtttggtagaattcatcagtgaagacatctggtcctgggcttcttgtcattgtcagaatatttttgattactgattcattctcattatcattatatatatatgttatgattttctatttttcatgatccagttttggtaatttgtatgtttctaaaaaaattatccttctagtttatccagtttgtgtaaaattgggtaaggtaatctcttatgtcccttctgattttgtggcaggggttgtcatgtctcctctttaatttctaattttatttatttcagtcttctctcttttttcttagttattctagctaaaggcttgtgaattttatctttccataaaaactctaaatttcatttttttattgttttttgatactcaattttatttgttctctaacctttatttccttctttcttctaacatttgtctcagtttattcttttctagttcctcgaggtgtaaatttaggttgttttcgagaaacctttcatcatttttaatataggaatttattgctgcagactttacttctagtactgcttttgctggaccccatatagtttggcatattgtatttttgttttcatttgtctcaagatttttattttatttttttctgtagacctcctctgtggacatcaagatatttttaaatttcccttttgattcttctttgatccatttgttattcaaaagtgtgttatttagcttccacacatttataaattttccagtttttcttttgctattgattgctagtttcattccattatggttagaaaagatatttggtataatttcaatcttcttaaatttattaaagcttgtttttgggatctaacgtgatctatattgaaatttttctctgtgtgctttagaagaatgtgtacttattactttggggtggaatattctgtatatgactgttaggtccatttgttctatactgttgttcaagtctactcttatgatattgattttttcgtttggatattctatccattattgaaaattgagtattgaatcgcctactattattgtattgctgtctatttttcctttcagttatgtgaatatttgatttttatatttaggagctctgatgttgggtgcatatatatttatagttatatatttctgttgcattggcactattatcattatataatgtcctttttgtctcttgtgacagtttatgacttactattttgtctgatataagtatagctactgttcctctcttgattaccatttgcacagaatatctttttccaatctttcactttcaacctatttgtgtacttaaacctaaaatgagtctattgtggacaatgtatagttggatcttatttttttacccattcagccactcaatgccttattattggggagtttaattcacttacatttaaagcaatttttcttagggaatcatttattattgccattttgtcaatcaatttctgtctgtcttttagttcttttctcccttttttcttctcttgcagttttcctttgtgtttcatagatttttgtattgatccgctttgattcctttctgtctctctctgtctctcttatttttgtttatcttctatagttattttcttgtggttatcataagacatatttaaaatgtcttataggagtctattttaagcagatgaaatgtatatcacgtacaaaaactgcatttttacctctgcttcacacattgttattaatctcacagtttgcgtttttctttttctttttttttttttttttttgagacagagtctcactctgtcacccaggctggagtgcagtggcacgatctcggctcactgcaacctccgcctcccaggatcaagcgattctcctgcctcagcctcctgagtagctggaactacagatgcacgccaccacgtctggctaatttttgtatttttagtggagacagggtttcaccatattggccagcctggtctcgaactcctgaccttgtgatccgcctgccttggcctctcaaagtgctgggattacaggcatgagccaccgcgcccagctccatgaatgtattttatagttacttttaatacttttgtcttttaagttatataatatggttaaaagtgatttacccaccagcattacagtattataatattctgaatttgcctatatatttaccttgaccatcgaattttatgcttctgtatgctttcgttttgctgtttagcaaccttttatttcaatttctgcattttttgtaaggcatgtctagtgttaatgaactcctgaagcttttgtttgtttaggagcatctttatctttcctcacttttgaagaatagttttgctgttatggttgacaaaggggtttttgttgttgttgttttctggagatggagtcttgctctgtcgcccaggctggagtgcagtggtgcgaactcggcttacggcgacctctgcctcccaagttcaagtgattctcctgcctcagcttcccaagtagctgggactacaggcacccgccaccatgactggctaatttttgtatttttagtagagacggggttttaccatgttggccaggctggtctcaaactcctgacctcaaatgatctgcccacctcggcctcccaaagtgctgggattacaggcgtgagccaccatgcctggcctcttttagtacttttattatattattacactcctttctggtatgcaaaatttttgctgataaatcctctgatactctaattgaatttcccttatacatgccaggtcactgttcttctgctactttcaaaatgctctctttgactttaacttttgataattgattataatatatcttagtgtagattttctgcgttcatcttatttggcatttattgggctttctggatctggatgtccattccctttccaagatttatgaagttttggatattatttatttgaatactctttctgtccctttctatatcttttttctttctgatgctcacataatgcatatgttggtttgctttatgttgtctcataagtctcttaagttttattcacttcttttcattctttcttctttttgctactccgacttgttaatttccaataacctgtgtttgagattactgatcctttgtcacgctcctggcttcaagcagtcttccttctttggcctcccaaagtgctaggattataggcatgagtcactgcacctgattttgctcatcctttcttctgcttgatctagtctgcaattgaacctctctagtgaatttttcagttcagttatttattgaattcttcagcttccagatttctgtttggtacttcttatattttctctgttgaaattctcactttatttatgcattcttctcttgacctccttgagcatctttatgatggttattttgatttctatgtaaggtaaatcaaatatctccataccattagggtttctggaaatttatcctgttccttgttctggaatatattttcctgtgtcttcattttccttacatggttttagtttcatagtactagaaaggcgaaaacatcccccagttagatacagtacccattttcataagacatttaggtaaaaggggttacagctaccttacataaagcttgtttaaacatcttacacctgttataattctattaacctgtatgtttttatgttctgatcccaggaagcctttttacccccagaccattttaccttttctggtgaaaagggtttgaaagggggttgggtctgtaagacctatgaggatagcagatttgataaggcttcttaaatagtcctatgattctgtgggaggggcacccatgtaaaaagggcccccttaacccccaaatttaccatgatccagataatagacatattaggtgggaggatatcacagttatcataaatctagtccaacatggcttgcgtatgaaatatattaacggtttcatctggggtacttcacttggtattttatagagagagttgggcagtccccttcttagggcaaatagaccttttaatggcattatctggcccactaggctgatcgctttctcaggaataaccccctgtgcattagtgattgttcagtaatgagctgttggtcctgtattaatccaaacaagcttttaaaatctgtagcatttaaaattaagaattttgttcttaaagtggttatttttacaatccactatagtgaagtttctttaaagaagccgaattataccaatctacaaaatggaacaatttctttatattacaccctttggttttaaatagttaattggttttgcccttccctcatatcgactattttcttggtaaccatagggctcagagttttgttgccctggcttgttctttttaaaatttacttagttttatccgtataagttcctttattataaagcaacttttaaatagatctttaagcaaaaaaacttacttttttgagaattgacatccttttgtttataaaactttaacaaaagcatattttatgcttctcctattttaactttttagtaacctaaatttctaatgggggaaaaaaatccaagggtttaaacaggactttaagatttttaaattactggagagttttcagattaaatttaccaaattaatttttaccaaaaaattaccaaggttatgtaaattagaaggcatctgagctagcttttaccaatctaataagcacttacattttttaagttacttgattagagctctcacatgtagttttgaagtgaaacatcacttccacatgacacatataaagatcgagatataacaggcatgcagaataaaagccatgttcaaaagatacttaatttgcctgttttcgaaaacaatttttctcccttacttagataattagtaaaagttacaggagccaacaaaaggtagaggaaaggaaagagccatcattcaaggcctttccgttttttttgaccgagtcttgctctgtcgcccaggctgcagtgcagtggtgagatctcggctcactgcaatcttcacctcctgggttcaagagattctccaagcctcagcctcctgagtaggtgggatcacaggcacccaccactacagccggctaatttttgtatttttagtagatacaggatttcaccatgttggctagcctggtctcaaactcctgacctcaggtgatccaccagccttggcctcccagtgtgctgggattacaggtgtgagccaaggtgcccagcctggccttttcaaaagagaaagagtggcacttttaagatatcaatctgaagaatgttaaagaaacagattatagaatttaaaagtttaaaaacttcttgcattaaaaataagtcagtatttgtaataaaattttgttttaaccaattatttagttttgtattagtgcatttccttttaatattaaagacccatctctagaaatattattatgatttcattttaattatagccaactgaattatacaacccctttaaaaattcattttgctgaccttactacgacttatgtagttcattcacaacatgtttagactgttttgtcttaaacatccctttttcttgtacaaccccgtcatttttattttagggcaaaaatttaccacacaagattctttcctatataaaattacttttttttaccttttttttttttttaccaaaaatacctctttatatctttaactttctttacatctcttattttctgattcctttaccttgttttttacataacccttaaataagccttgaattagacaaagatattttacctttaataagaatatttttttaaaaaaggttttcctgtaattcttaaattagaattgcccatttaatactaattaataaccttagatcctaaattatgacaagtttgtttaaaagcatttatcctgttacgtttacctgattaatttagtagtttacctagattatttacaaaaactgtgatagccaatatttaaagttatttttctattaaccattcttatagctgtgagtttcaggtatctacttaagtaataaaacttatggttagttttaagggtatttataccaatagctgagtatttagctgttttcatttaagccaaccatatttcataagcatatacaagcaaagatcattctgtcttaggctgggttttatagtttataacccttatggcaaatcttatagtattctgcaggaataaacatgaagctacttgattaatagatgcaaacataatgttaacaattctaaagacattgctgatattattttaccaataattttaacgccaccttatttagtaaagatttcacttaagtcacatgagcttgaaaaagcatttgactagtcttcctttttttctaagtatctgatttgagcactttttaaagccaattaattagagctctttacatatttttagtattgaagatgttgtgtacatacacataaatatatagacgtattaagcatgccaatagaagcacattgcatagacttataaagaccttcttttttttttcatgttttaaaaatcttaccccaggcagttgtcagctaaatagccttacatttgtgtattaaaagcaactcaggtgaaaatcagatagcaaagtttacatcataaggtaagaagagaaagtctggtgtgctagagggaaattaaaaaggattcaattgccaattgaacataaaattatagaagtctattataaaggcctttaaatatacacacacacgcaaagttcccgtagctattacttcagtactttagccatgagacaaatacaactttgccagtttgcaaaacaacaacaacaacaataacaacaacaacaacaacaaaaaaccactgttagatggcagtggtttttatctcagttgaaaagtaacagcagatttaaagcaggcagaaaataaaatagaacccaaaagctctatagtttgcaggtcaaccttaggactctttttccttaatgtaaatgtgcacaaagaccatattacttccattttatataactctggcaagtacaggtgtgataaaacctatggagcgcccagaagggggtcattctccttgttttatctttattccggcttttttttttttcttaaaggaggaactgagctgtgccctaggttcttgtgtggtggatccacgtgtgctgtttgtgggatccatgtgtgctgtttgcgggcaggactctacagtttgtcaccactgagtgtttctgccctcttacgtgtctcagtttctctctccagaggtctatgacctctgaaagggctcaaaacgctgggtaatgagcaattctatgcgtttcctggacgagccattttttaaaattgatttttgttggggatttccctgcagggccgctgcacatctcggggagtcaaccccccagacactcccatgaggctcccggtcacccaagggcacctttcagctgggaggagcaaatgccctttctcttcagagatgaaaaactcagtctctcatttatctaggaaaacaacagctcagttcctcacacaaatgcacacagacaaaccggaataggataaattttagtagaaaaagcaatagagaattccctttagaatgcatctctgaactagaattaggatccttaaacaacaacttcctaggagaaaaccaactcagaataaatcaaggaccatcaaccaaagggaggtccaggactcagaggactcaccagttccactggaggagaagctccaacgcggtggggcttcaatggacccctgctgatacgttagctccggtttcgggcaactccttcggggtcctgagtcttctctgaggccccatatgttttgggagccagattattgttgacgaaaagagtcaaactctgtaaaatattttaagagatttattctgagccaaatatgagtgaccatggcccgtgacacaaccctcaggagctcctgagaacatgtgccccaggtctttggggtacagcttggttttacatattttaggaaggcacgagacatcagtcaaatacatttaagaaatacattggtttggttcagaaaagcgggacaactcgaagcgggggcttccaggctataggtaaatttaaacattttctggttgacaattggttgagtttgtctaaagacctgggatccatagaaaggaatgttcaggttaaagataaagtattgtggagaccaagttttattgtgcagaggaatctctcagatagcagacttcagagacagcatgttgtaaattgtttcctattgcacttaaaaggttgccttgctcttagttgattatctcctggatcgagaaagaaaggaaggaaaacaaagggggaaggggcttctctatagaatgtgggtttttctcacaatagactttgcaggggaatttcaaggtctggcaaggaaatatattttggggttaaatatttttttcattgtctcataatgttatgccagagtcagattgaaaagtaagtcacaatacatagggtcaaataaagctcatctgatgagaatttatggtttgtagggcatgactccctcgaccccttaggtaggaatttgggtaagaaaaaaaatcagagcgtagtcctcaaatgcatcatcagaaaaggtcaccaaattattggagtagcgcactccaaaaccctgttcttccactaaaagaaaaattaagcaaaagtggtcagaatcaactttttcagaactctagaatataatcccaaacttacaatgactaggggaatgtttaatgaaagaagctgctgaagtttgttaagagaactctgatgatttaactcctcacttcccattccccactcccaccagctcagtggtgagtatcataaaaacagcaacccacatacctggtgcagcttgctagtaccagaggagcaatataaaacactttttttttttcttgagacagagtctcccccagtcgcccaggctggagtgcaagtggtgcgatctcggctcactgcaacctctgcctcccgggttcaagtgattctcctgcctcagcctcccgagtagctgggattacaggcacccaccaccatggctggctatttttttttaaaaaatatttgtagtagagataaggtttcaccaagttggccaggctgctcttgaactcctgaactcaggtgatccacccaattgtgcttgtttaaagacttaaaaataaggacaccatgctaagtgaaataagccaaaaacagcaagaagaatactgaataatttcacttatatgtagaatctaaacaagtcaaatacatagaaacagagtaaaatggtagctaccaggggttggtgggtaggagaaacagggagatgttggccaaatggtacaaagttgcagttatataggatttataagtctagagatataatgtacagtatggcaactatagttaataatactgtattgtagactgaaaatttgctaaataaatgtctatcagctaatgaatggataacaaaatgtgttaccatccatacaatgaaatatattctgtcataaaaaggaatggagtgctgatacgtactgcaacatgaatgaaccttgaaaacattatcgtaagtgaataaagccagtcaagaaaaatcacatattatatgactttatatatatgaaatattctcagtaggtaaatagagagaaacaaaactaatggttgccatgggctgggtgaaggtaggtatgggaaatgattgtttgggtagtgagcttccttttgggatgatgaaaaggtcctagacttaggtagtagtgatggttgtacaatattgtaaatgtactaaaggccacagaattgtgcactttaaaatggcaaatttatgttaagtgatttttactacaacaataattttataaaacaatgagaaacagaatgatgaagcaaatgtggtaaagtgttaacatttgggagtcctgtttgaatatgagaactatttgcaattttgcagattttctataaatctgaaatcacttcaaaataaaatgttacaaaaagtttcaagactaatgaatccagataacagattgttgggttattcttaagtaaaagaataggcaactcttccactgaaggtgaagggcagaagggaagtatgtgtgtggatttaattaagtttgtaactggatcaccagggttatagatcatccctgggataggggtggggtcattgttctttctgtgtaatagaaggttagtgcttttgctgaaagagaatgtcttagcattgtaccctcagaagttaatactgagacagggtttgcgtgaacatagtttatttgggtgttacttccaaaaatcaccattagatttatttaggaagttagacaggtaggagaagtaagccaataaaatgtgtactatgtagcaggtttccgctttggccaactgtggctcagtcttgctgggaaatgctgggaaacagagcagaacatacatcagaattactccattttagaagcaagggaactggaatatttcttctccatcttccacctgtcattggctgagagctcctcccagggacattagctttccacgacttccagtcctccccaggccagctgagataaaagattttagttgagaggtatgggtgtttacagtagggtgaagtcagcatgtactggagcagcagggactgaggaaatatttgaaagcattgacagcaccttcaataatgagatagaaaatgaggaaaaacatggtttgaagagagtgatgaggttaaaaaatatatactagttaggagtgggcaaagggatcctctagggaacatgtatattggttgccatgattgccatgcaggcttttgaacctgatgaaagttggtgtccatggatttatcatggcaccaatcctcccatggtcacagagtgggtggagtatagaagctgtggaagcagtcaggaatttgaccttttgtgtttttcttagcaattgtataaacctattagcacatctcactgagacttcggactacgaaaacatttgctcgtatattttcatatgaagtagaatactcttaagctggttctctttcttatacatacttaggatgtgaacctcaatatataagtttatatttatataatcctgttgttttcaggatttccaggctttagatatcggtacattttataaggtcatgaaactaaatcttcgtcagcactggatgaatgtgccaactcagtgcatagtagtgggtactatataaaagtagagtggcctctgccctccaaagctcaaaaacttgcagggggtgagaaacctgtaaatagataagcaggatacagtggattcagtgctgtgatagagatgcataatagatgctcagttaacatttgttgaataactgaatgaaatgtgatccaagatacaatttttcttgttggaatatgcttatctttaagggtgtcatctaagttgacaaaatgttgcaaatggcatgttcttagataaagttagtgactacagacttcaactgttatcaagaaaagatgtaaatatttaccatcacatggtgagaaggttttcttaactcttgcataagcagactagggaaaacagaagaaaacactgtgacccataattttccaaatttgttttcatgggaggggagaatgagacacatgagtcattttcacttctgttagctgatttttctcatgattattaagccacagaggccacattgcttcttctatggtgatcaagtttaacagagaagcatcatgagtcctgaaagaatctcactccatgacgatgaagtgtgtatattctgggaataataatgaactcatctcaccttgacactcataaaagtgaaagcctttagtagctagattttaaatattttacaattgttttattagccatgcaacaatttcttaaaatttattttcatctaacactagagacaaataaagaaaagtcctggccaggcatggtggctcacgcctgtaatcccagcactttggaaggccaaggcgagcagatcaccgaccagccttgccaacatggtgaggccctgtctctactaaaaatacaaaaaaaaaaaaaaaaaagagctaggtgtggtggtgcacaactgtagtcccagctactcgggaggctaaggcaggagaatcgcttgaacccaggaggcagtttgcagtgagcagagattgcaccaccgcactccaacctgggcaacatagcaagactccacctcaaaaaagagaaaaatccttctctatctcaaagaactcacaatcttttgtttactaacatcactttactcttaataagaatttgactttactttgaaaaaattatttatttactcaaccaatattatttagcactgattatattcataagaatgtgctagaaatcaagcacagtagatgaaaaaaggaaggtccctaccatcgaaaagctcagattcttgcagagggagagagacctgtaagcatgcaagaacaatgatttcaatattgttataggccaggaaaagaagagaaaatatctgcctagagaaattagtggagactttaggaggagaagccatcctactcagtactagggatggaaaaaaaacattttgtagacatcaaggagaaagaaggtggcttgggggtaggaaagggaagagggaagtggaagtatgaaaggcgttccaggtaaaggaaacaggagatatacactcagcaattgtgacagagcatagaatgttctggaaatgaatggtcagggggttaaatattggtttgtgtggggaggaggaaatgaggaataatgcaagggaggtaggatagggagaaatggtgaagagtcatatgagatgtattctgtactctactttgtggggtagaagggactgaatgttagggaaatactgttgtgtccaccttaaagatacaggatgaacaaccacccaaatttgatttcggtatggggaccaatgatcacacacacacacacacacacacacacacacacacacacacacacacgaagagggtatgaagatttcttactcacataataaggctttctaggaagagtagggtgactcacaagcagtaaaaatggcttgaagttttatggtggttagtgagtaaggccagggtggttcccatgcacaggaaggggttggtggcggtttgaattttccactggcaccaaaggagagaacacctagactttattgttagcttgatcacttgtaggatagaagaagaaaacggagtgtggctttacagctatcagaaatcaaacatttaaaaaatggagtcagtctctttatttcactagtgcaatcacatttttgaaaattcaaatcaaaaccaaaaagaacccagtaatagtgagaaaataacctggaaaaggatgagaatggaccagagaaaccagcaggaggtcgtggcaaatacctgggcaaacgaaaatgaggtcctgaactatcacactgacaatgaggatggtttggggaatatttctaagaaagaattgagagttggtgcccataatgagtgagagaggctattagatgactttgagatctgattgggcaactggagaaaaaatgacaactaatgataggatatatgggaggaaagacaggtggtgagggggagacaagttattatttcagttttcaacatgtgattgaaacggcttagagccaccttgtcttttgagaaatgaaccgcagtagttccaggctctgtcttttcccagatcaacttatgtgatcacataacctggtcacacatcataatgcttacaaataaagcccctctgtgaatctcaattgagcatgatttaattttcattttctatggaaattttattgtttctttccctattacaaaagcaattcatgttttatataaacaattatgaaatatagacaagtagaaagaggaaaatacaaatgaccttccatgaagaagtgataactaataccattttggtgtattatcttttagagagtaccattggagcccaaatatgagaacaaaataacctagaaaactgagaaaaagcttcaaagatgaaaaaaatgttttatttgggtctttaaggatcttgagtacatttactggctataaaggggagaaggtgaggtgaaaatggaggttcaggagaagaaggaagggtaaacattttaaagctgagattgtgcagtacattctgtattataacataatgattttaacttaatatattatttaacttaatatttaatttaatctattatgaacacaaattgtaagtgaaatttttgcagtgaaatacatacagtgattttgacattttgttttgtaaccaaagagtgtgtgagacaggtctccatcaatttagaagtttattttgccaaagataaggaaatgtccagaagaaaaaacatgaaattacacaaacagtctgtggtctgtgcctttctccaaagatgattttgagggcttcaatatttaaacgggaaaagtgggcgggaggggaaagaaggaggttatagtcacattactgaatccacatgttgcaagagaaaaggagcaggtaggggaaaggttaattatgtattcatctcactttacataagataaggtgaacatagtgtagccgctgtggggatattaaatctttaatatctagctatctgcttctgaacaaaaggaaagacagtttcttgcatgactcagccttcagcttaatttttttccttttggatagtgaattgggttctgagtttttatttttttctttcacagtttgtattatgaataaagcatactagatagactatctttctgactctggaattaaagtaaggaggtttttagatgtgataataaccactctccactttctctctcattctggcaaaatgtctgagggaagatctcactctgcaagtttagctttcatgaaatgttttcaaatggagtgatggctcctcctaactgaagacagatcttcagtcttgtgtttgcttgccactgaattgtgagagtactttttctctgtaatagagtaaatgcttgaccatttctttttttaaattttcttttcttttcttttttttttattatactttaagttctagggtacatgtgcacaatgtgcaggtttgttacatatgtatacatgtgccatgttggtgtgctgcacccattaactcatcatttacattaggtatatctcctaatgctatccctcctccccctaccccacgacaggccccggtgtgttatattccccttcctgtgtccatgtgttctcattgttcaactcccacctatgagtgagaacatgcggtgtttggttttttgttcttgcgagtttgctgagaatgatgccatttcttactgcctaaagaattaaacttcctttgcacctatctataagtaaaattctttcaacttgacttaatttgtcacttttggaaattacataatgaagtgtttttcagaccactggattatgtatcatggaagtgttttcatgcactaaatccatatggtggtttcaattgccaatagaggaaatactctggattccccacgaagtactgggagcctggggttctagtggttccacaattaggtagtgtgcaacagttatctattgccccaataatgctgcgtaataaactggcaagccttagtaaatcaaaaaacaaccagaattctactttcagtataacagtgtgagatgctctgcaaactcaaccacttaaaatctctagaaatgatcctaaaggcgtatagcaagggaataaatgtttaagaaaatctattaaaattggtgggaatagcaaaagtctatggtatttgaactaagacccagcctattcttctccccttcaaacttagtgaaatggaaactccacttaggactggtacagcaaagaacacagggttccttctccctccagtttccattccaagggctacctttaagagaagttcaggacttcagcattttttaacctgcccgcagctacctgttgctaaggctaagttctggacaaggtgaccaagaagtgggggcttgcttcttcatcctagcctccagtatataggatggaatctctaccttaggtgtggcaacattgagtatactgggacctgatcatctttgcatagattctaatccatgtgtgatccacatggagagaggcaagctgagaagaactaatgttactacctatgttcagaagtgttcagctcctatgacagggatgtcactcagagaataatgtgccattatctccattcccagcttgagagccaaggtatagagattattccccggaggagaagcaggccataaaagatagaaccgtgaatctcttccaaaggaactgactttatttgcaagaggaagtggagaaattcaagcctaatggcattctcaaaaacagtggaagttgttttaaaagacagttgagagtagattgctaaattaatcagagatatagacaaaactgtaagccgactgctttgctggagaggagcttggaaaaggacaggtgtgatgagccctactggggacagaacaaattttatttttgttttatttttgagacaaggtcatctaggctagagtgcagtggcgcgatcacagcttaatgcagcctcaacctcctgggcccaaacaatcctccctcctcagcctcctgagcagctgggactacaggtgcatgccaccatgcctagctaatttttgtatttttttgtggagatggggtttctccatgtttcccaggctgctctcaaactcctgagctcaaacgatccaactgcctcagcctccaaaagtgctgggattataggcatgagccaccgcgcccggcctgagagcaaattttaaacattgacctaggtaactaacctgtcaagagagcccagactagattggatcagtctatggagcaatttatgccctatgttagaagcaacagaacaatcagccagtaattagtggaatttaatggctggatgtgatcagggaaagagaaaaagagagctctgcccaaaccaatgtcatcccagggtaactatggtcattcccaagtctgcacctcatgaggagcagcatcaaaggttttatactgcaagagagggagagtgggttgaactacacttcactaaaataatctaaccagtcactaaacaaacaggcagaaaacagtaagtacttagaggggaccaatacccagagttgccacaacatattatctaaaatttctgatttccaacacaaaattgtaagacattcaaagaaacaggaaagtataatccatataccagaaaaaagcaggcaacagaagctgcccatgagagcaacaagacatgtgatgtaacagacaaggactttaaagttgtaattataaatatcttcaaaggactaatggaaactgtgattaaagaagtaaaggaagatatgaaaatgccacatcaaatagagtttactaataaagagatagaaatcataaaaaggaaccaaattgaaattctggatttgagagttataataactgaaatgtaaagttcaatagagggctgactagtatatttgaatggcagaagaaagaacccatgaacttcatgatttgtcaactgagattgcccaatttgaggagcagaaagaaaaaaagaatttaaaaaaattaaagaaagttcttcaggctgaaaacaaatgatcccagatagtaattcacatctatgcaaataatgactaaataagtaagataaacagagcactggtaaaggtaattatgtaattatgaaagagagtgtacatgtattttttcctatcttctcttaactgatttaaaaagcaattgtataaagcaatatgtaaataatgtatgtcatacatgtagtatatagaaatgtaatctatttttccaataataccacaaaaggggatgggtgggagaaaagccatattgggttaaggaagtgactccagatgatagctgaaatccacagaaacaaatgaagagagccataaatgagaaataagaaggttcatataacaaaagctataagtatatgtttgctctttttctctcagcttctttccaatacataaaatatataaaataataattatgtcaatgtattgctgggtttgtagaatttatagatttaatatataataataagaccataaaaatggggaaataaatagaactatatagaaataatgtctctgtatctcaatggaattcagtttctgataagttaacatatgataagccctaaagaaatgactaaggaaataactcaagaaaatatagtgaaaaaataaagaaaattctacagtagaaaatattcatttaatgcaaaaggaagcagtaaagcagtaatataggaacaaaaaggacatgtaagctataaaaaacaaaaagtaaaatggcagaggtaaatctaactatattagtaatagcatcaaatgcaaatggattaaacagtccaaataaaaggcagtttgtcaggctgaattaaaaaacaagatccaacgtgtgttgtctatagaaaacatactttagattcaaagacaaaaattgattgtaagtaaaacaatggcaaaacataatcgtgcaaataaccacaagaaagctggagtggctatattaatgtcatagaaaacatatattaaaataaaaaatgctactagagataaagagggacattttcaaatgataaaagggtcaacccactgggaagatataacgataatgatcatctatacaacagagcaccaaaacatatgaagcaataaatagacaatttaacaataatagagactgaataccacacttccagtaatggagagaagtaggtagaacataaacaataaagaggatatttgaacaccacaaaccaactagacctattaggcttgcatacaacactctacccaacaaagtaggatgtttatttttctcaagtgcacacacaacattctgaatagaccatgtgctaggccataaaataaacctcattaaatttaaaaggatagaaaaaatgtccactgttttttctttccacaatggagtgaaactacaaacaaataacagaaagaaatgtaggaaacccacaaatctgtggaaagtaaacgacacactcctaaaaaacaatgggtggaagaagaaatcaaaatgaaaattagaaaataattagggatgaatgaaaatataaacatcacatacctaaacttatgagatgcagctaaagcagtggttagagggaaatgtatagatgtaaacacagatgtatatttaaaaggaaagaggatctcaaatcaataaattaaccttccacctaagagactgaaaaaagaagggcaaactaaactcaaagctagcagaagaaaggaaataatacagaccggagcagaaattaataaaatagtgaattcaaaaaaatagagaaaattaaaggaactaaaagcttgttcttggaaaagatgacaaatttgacaaacttttagctagataataaaaaagagagaattcatattgctggaatcagtaatgaaaagggaatattactactgccattgcagaaataaaaattatcataaggaaaggccatgaacaattttattccaataaattagataacttagataaaatggacaaattactagaaaggcataaactactgaaactgactcaagaagaaatagataatctgaatagacttcttctaagaaataaatagattgaattagtaatcaaaaaactacctaccaagaaaagcccaggcccaaatggcttcattggtgaatgctaccaaatatttagagaacaattaatactaattcttcacaaactcttacaaaataatggaaaaggagggctaacttcctaaatcatcctatgatgccagcattgcccagataccaaagccagataaagacatcacaagaaaggaaaactacagaccatatatcttaagaatatgggtacaaaaaccttcaagaaaataataggaacttgaatccagcaacatataaaaagaattgtacaccatgaccaagtgggatttatcctagcaaggccaagttggtttaacaccccaaaattaattaatgtaatacactacatcaatagaaaaaacatataatagtctcaattgatttagaaaaataatttgacaaaatccaaaaccatttcaagataaaaaatattcaacaagctagaaatagaaaggaacttcctcaacttgataaagggtatctatgaaaaacctacagccaacatcatacttaatagtgaaagactgaatgtttttcccctaagatgaggaacaaaacaggatgtctgctctaaccacttctactcaatattgtactatgggttctacccagggtagttaagcaaagatacaagtaaaagccatctagtttagaaaggaagaagtaaaattaactctattcatgaataacattatcttatatatagaatatcctaaagaatccactaaaagtctattagaactagtaaatgagttcagcaaggtttatgggatacaagatcaatatataaaaatcaattgtctgagttacgagcataaatgtaaacaaagaaaaaatgttaaaaacaaaaatatcaattgtctttctatacacttccaatgaacaacctgaaaaggaaattaagaaaaataattataatgcaacctaaaataataaaatatttaggaataaatatcacaaaagaagggcaaagactatactctgaaaactacaacatattgttgcaaaagtaaacatttaaataaatggaaaaacatatcattttcatggattagaagatttaatattgtcagattggcaatattccccaaatttacctacagatttaacataatccatccctatcagaatcccagtttatttcttttttagaaattcacaagtggaacgtaaaattcatatgaaatttcaagggactcagactaattaaaaaaatattaaaaaacaaaattgaataacttacatttccttatttaaaatgtattacaaagcaacagtaatcaagacattggaactggtataaacatagacaaatggattagtggaatcaaattgagagtccagaaataaacccatacatctatagtcaaatgatttttgaccattcaatggggaaggaagagcactatcaaacaaattgtgctggtataactgcatagccacatgcaaaagaaagaaattggacccttaccttagactatataaaaaaattaactcaaaatgaatcaaagaactaaatgaaaaagttaaaaccataaaacttttggaaaaaacataggaaaaaaatcttcatgacctctttttgggcaatcgattcttatatgtgaaaaaacacaggcatcaaatgaaaagaatagataaatcgcactttatttttatcaaaataaaaacttttgtgtttcaaaggacactattttttttttttaaagaaggaagggctttattcagccaggagcttcggcaagactcacgtctccaacaactgagctccccgagtgagaaattcctgtcccttttaagggctcatgactctaagggggtccacatgagagggtcgtgattgactgaccaagcacggggtatgtgacttggggctgcatgtaccggtaattagaacagaacagaacaggacagggattttcacagtgcttttctatgcaatgtctgtaatctttagataacataaccgattaggtcaggggtcgatctttaactaccaggcccagggtgtggcaccgggctgtctgcttgtggatttcatttctgccttttagtttttacttcttctttctttggaggcagaaattgggcataagacaatatgaggggtggtctcctcccttattcccccgctttgagaacctcattcaatagtggaagttctcacttttattctcactacccatgtcttcttgcaagacagatcaatagtgattcatatagtacacttgtgctgaagcattttggtgaactaaggtagtgatgaagctttttatcatttgaagaagtacaggtagcaaacaagggagcagtaagcaggtttctattactattataactcataagagttttaaatctttttttattattatactttaagttctagggtacatgtgcacaacatgcaggtttgttacatatgtatacatgcgccatgttggtgtgctgcacccattaactcatcatttacactctcattttttgcactcaggttcagcatacttactagctttcatttaaaacatgccaaatactttactagtctggggatttgtccatggaatgttatttatcttaccacttctctgactcattccttattcttgtgacagttctaaggttcagtgtcatttcaacattcctccataaccctatgtaaattacatccttaaaataacatttaaaataacattttaaatgtgaataagtgattatcaattgagaataattttgtcctctggctactttttgacatcacaactggaagatgctactatctagtggataggggccaaggtactgctgtccttttttaccaggaacagcctttatgccacaaaacaaagaattattcagtccaaaatgtcaatagtgctaaagtttataaactctgcttttgatcatgcacaataaatttgaaatacatatttgtttgggtgtttgttttaacatctgtctttcctactagactggatgtttcataaggatgagatagataatgcctagtttgcttaacattgaatatccagcatcaacctcagtgtctgatgccaggtagctacatgaaaggatgaaacagcaggcatgaggtaagaagaaaaggaaaggctttattaggagggtatacaaacatttctgggtatagaagatgctgtcagtgccctgtccatactccaacagctcataccatttaagtagatatttgcctgactttcaaatgtcagaacccttatttctttgtgtgagacctttcattaggtcatcagagcccactgtgctcaataatatgacagtccagaacagtgggacatcatctgcccctggaagatgtgtttactacagcgttctctaaagttttacagtgacattagctgcttgataacgaatactttgtttgcttcctttccttctctgtctcaattcctctcttccctgccagagtttcctgggaataactcctgtgataggccgagtaatggtccccaaagatacttagatcctaaccccttgcacttatgaatgttgccttatatggaaaaagagaattcacaaagatgattgtggaagatgggagattattctgtattatctgatagaacctaaggtcaatcacacaagttcataaaagagtgaggcagaggcgaatttgacacagaagaaggaaatgtgactactgaagaaaaatgctatgctgctggctgtaaataggaaggaaggggcccatgagataaggaatgcagctctaggagctgggaaagtcaaggaaacagaccctcctctagagtccccagagggagtatggcaatgttgacaccttattttcagcctagtgaaactgattttgaacttctgacctccaggtttgtaagatactaaatgcgtgtattttaaagctaccaaatttatggcaattcattagagcagccatagggatctatcacaatgtttggtccctggaagtgggttgctgctataagaaatatctaaaaatgtggaagtggctttgcaactggataatagctatagactggaataattttcaggagcattatataacaaccttagattatgttgaacagatcattaatagaaatatgaatgttcaaagtgttcctggtgagagctcagacatgaggaacacagtagagaaagtctatattgtcttagagaacacctaaattatcataaacaaactattgatagaaataaaatgtcaaaggtgttgctggtgaatgcttagaaagaaattagtaacataatatcagaaaagggagtttgtgttatatagcatcagaaatcctacctgaattgtgctctacaattatgtggaaagcaggacttgtaagcaatgaacttgaatatttagctgagcagattttcatgcaaaggattaaaggaatggcctgttttttattgctgtttatagtaaaatgccagaggaaagacataaattgagggaagaactgttaagcaaaaagaaaccagaattcaatgatatgagaaattttcagcctatccagattgcaaaagacaccaaaattaggaaattcattgccacaaaatcatcctccagagataaaatcaagggcgtggctagacatccttttgttagtgcctttaagggatcaaaagatcaaagtattcaatcacatagatggtgttttgaagagatatggggtgtgcttctcagaataagcaaggaatagagatgggattttctatgagggatcttgaagaagcctcttgtctaatggcatgaatccccatgacatacataaaaggcctgtaagtttttgacaatgttatatcagcagaaacaatgccagcttagactgaaagggacaaatagaggaagaaatgaaagaagtctacaggactctcaaaatttgacaggaggaagcaggctgataaaactactcagctgtaaacatatgctaccattcaaaataaaggaacaatgactgagggcagaacctagaggccagagggcagatttatgaccccaggtgaagtcataggatcagagtcatcaaagggaggagtctcaagccttagaatattctcaggccttgaaacctaatggttggattttgaaaatgcttggatttgagactcctttttctttccactttttcccttgtggaatggcaaagttattggctgtaaatgaaccaaagtcaaagggaaaacacagaattagtagagaagaaaattaaataatagaaaagaaacatctcttagtgctttggcttcacctaggagggacaagaaatacacatctgggcttaaactgagcacaagatgcacttctctatcaactgtttacctggcactgacaggtaaacttattgaacatcttattattattattatttttgagaccgagtcccgctctgtctcccaggctggagtgtggtggcacgatctcggctcactgcaaactccacttcccgggttcacaccattctctggcctcagcctcccaagtagctgggactacaggcgcccgccaccacgcccggctaattatttttatttttatttttatttttagtagagacggggtttaactgtggtctcgatctcctgaccttgtgatccacccacctctgcctcccacagtgctgggattacaggagtgagccactgcgcccggctgagcatcttattattaattgaaaaatgactaaaatatatttttcaaatggggtaaaatcatgacactcatacagatatgaaatgaacacatgctaaaagaaaaagatgttatgactgcttcaaaagggaaaccaaagagttgatatgggaatattcatcagtaatattaaatgattgtgtaaatggaggcaaaactggtttcataaggtgaagaacaaccgaacctctactaaagaatatgctgtacatgtatcagcagcctacaactaacaaaaggctataaaagacttcacagataatgtaaggctggaatcagataacctgcagtggtgtcctaaagacagagcaaagttttccactgaagcacacatttatttttataatgtcaaaatcaggtagagagttatagttccctcaaaatcaaggttcagtcattagcgtgactagatcagtgtcatagacatttctaggctgaggtctgataagggaccagtggacaccaatgaaatcacaaagtctagggatgtcacaaaggcagctagctccctgaccaataagggcctggagcagagggatacaataggcaggactaagcactagtgtcctcagagacctacttgagctagagaatcaagcagagctgatgagagccaaacccagcaaacatcatgtcagagaaaaagaactgtaagaactcgtctacaaataacaaccagactcaagacccttctagaaatgagctacaggtccctaggagcttcgtggaccgcgttgtgcaagatgaacgagacgtccaaagccagagttcctccacaataaataccctccttaccttgctcgattgccttgctgactacatcatggagcgggtaggcttggaggccagcaacaatggcagtatgcgcaacacttcacaagatagggagagagaagtggacaacaaccgtgagccccacagcgctgagagtgatgtgactcgctttttgtttgatgagatgcccaaatccaggaagaatgactgaagactgggtcccagagccttgaagggaacctcacaggcttagccagggcaaaaatgtgtcacagctgaggaatatctgctgttgtcatcaacaagtgctattaaaggatgtaaatccatgagtatgtttctgactcctctcagtttctgtcgctttgggttgtaggtgtctgtaagacatccaggggaagctatccccagagagctgaaggcggggaaggggtggccagtgtggtgtttgaatcagtgatttagagggggcagtttccaatggtgacagtgagggcgccggccctgtggggaggaactggctgggataaagacaccgagacttcctcattgtctctgaacaggaaggccttgtgaggccagggagttggctgggggcctctgaggcttgttgaattcccagcctgatgctggggcctgaggtggagctgcagactctgactgaggtgcaggaggctttattcaggatagcaaaggtctgaagtcagagggcggtggccacaggggtgggtggagaggggcacactggctggcatgaagttcatgggacaggggctttacatggagattgaagagtgaaggagaaaccatcatgaaaaatgcaaaaaagaaatgatggcctgctggatttcatttcttatttctttatgccctgccttattatgaaagcggatttgagacagggattattagctagtgctgtgaatatatctttttgtcctctcttcaggacactggtaaaataaatcaaaagaatatataaaatttatgatctggcctaagatgggcaattcaagaagttcttaatggttgttaattattaatgaatcagcttaattataaatgtatttcatttaaaacacgattaacaatttcatttttaaattgaatacttattcattataattaccatatattgcatagagcaccaaaggattattagtgactcaatccatgttttaagaggtatagaaataattctgtcccaagtggcggcctctaaagcacatgcaatccttttcaaaacttcctgctctgtgctaagtttaaaagaggtgtcacatcaagtgttgtagcaatctgtccccttgcctgtgagtgcccacattttaggtttccacctcttccttgggtccttgggagccacagtctgctgcctgctggcctttcacagagggttggtcagaggctgcacagccggctccaacaatgggagctgcgggcctgggtttcagatcccagttcaccacttcctggacatgtgatattagaccttcaattactccctctgagcagtcctcctcatgtgtaaaatgggggtagtaaaagtctctccatctgtgggttttcccaagattgagtccacttgtgcctgtaaactgctgttccacacagtgcatgcacagggtcccccttaataaacagttgcatctccttccttccctaacagcagacctgtaggcaggcttccccaaggtgcagtggtcctggttctcaggtgaccactggggacttaggccactggctgtgagaaccacatcctgctgagccctgtggagagacaggaggaatttgggaatatttaatttatgtaagcaaaagagactttataatcgaacacgtcaataccatccagaggtaggaaaactttacataatcacacaatcagaggtggagctatttcagaattacaagcacatagacatataggcacagagagatagagcttatagcttcagttctacaatttcaaccgtgagtcaagtgtaaatagaaacagtaaagttctctgatccaaatataaaaaaaaaaactgttctcctctaagagagtataaaattcttaattgatttgagctataaatagacaaatggacaaaagactgtcaaaccagattttctgttgtcttttacacaacagagactgtatttctatgaatcattaactcatttacacagctctccagatggttggatcctaaaactgaattcccaaccatttggtcaacaatgaaaataacttacctaatgtcaatgaacaacaacaacaacaacaaaatacagaattagtagagaaaaatattgaaataaaaattaaatgttgaaactaaaattagaaaaacacaatgaacaaagacttatttgggctttggagtcacctagatgaggcaagcaaagacattcctgggtttaaccaagcatgaagcacacatctctgtcaccaagtttgcctagctctgatagatgaatccactgggtataacattgtgacctttaaaaacaggtaaaaggtattttctaacagagtaaaatcataacactcaaacacctatgatatggaaatgcgttgaaacaatcgattaactcgtgaggaaattggcggatattataagccattcaaaagggaattcaaagaataaacataggaacattgatcatgaatgtttaagtaaatgtatacatggaggcaaaattgggagcaaggcagtgaacatgtctgtaagtgacttacagcttctagagggaatgtaaattagctcacagacaatgcaaggctaaacttaaagaacctggagtggtgtcctaaagacaggacaatactttcattgacacaattttttgctaaaatgttaaatagaaaatgagcttttccttaaaaataagttccagctactagggcaaccaggttcctctcaaaaagaagttccagttactggggtgaccaggttcctctcaaaaagaagttccagttactagggcaaccaggttcctctcaaaaagaagttccagttgctagggtgaccaggttcctctcaaaaagaagctccagttactagggtgaccaggttcctttcaaaaagaagctccggttactggggcaaccaggtccctctcaaaaggaagttccagttgctagggtgatcaggttcctctcatgggcttttctaggctgaggcctgatcagagcccagtggacaccaatgacatcaaaaagtggaggttgtcacaaaggcaactccctgaccaatgaggggctggagcatagggatacagtgggtggcaataagcactggtaccttgagaggctcaggccagcaggaaaatcaagctgtgccaattggggcaaaacccagcaattcctcatggctggaaacaaaatgttctgtaggcctaggagacaacgcctttcccattccagaagagcagagctgcagtttcctgtcagccacttggaacgctgcctgcgagaaagtcagcatgcccggcacctgagctcaaccacacctgttttcctggctggtgttctcgagtatctgacagccaacatcctggaaaaggtgggcaaggaggtcaagaacagctgcaggctgtgcatcaccccagaacacgtgaagagggcactgcaaaaggatgagcagctcagatggatcttggagttggaagatgacacccactctcaagtagaagaaatgccccaatctgaggaggaagaggaggaggaggaggagaaggaggaggagatggtggtgctggtggtgatggggggaaggaggaggaggaggagaagaaggaggaggaaggattcctgagtttcggagccatgcgggacttcatcagcaacctcctccagatgccaaaattcccatagatgaaagaccccaggttgcttccatctgcccaagctattaaactgtgtaaatgcatgacagtgctcctgactcgtctccgtttccgttgctttgggttggaggtgtctgtgagacatcaaggagaagctatccccagagagctgaagcgggggaaggggtggccagtgtggagtgtttgaatcagtgatttagagggggcagtttccaatggtgacagtgagggtgccggccctgtggggaggaactggctgggataaagacgccgagacttcctcattgtctctgaacaggaaggccttgtgaggccagggagttggctggggtcctccgaggcttgttgaattcccagcctgatgctggggcctagggtggagctgcagactctgactgaggtgcaggaggctttattcaggataacaaaggtctgaaatcagagggcggtggccacagaggtgggtggaaagagggcacacgggctggcatgaacttcatgggacaggggatttacatggagattgtgttgggattgtccttagggctatttgggagatatgcttgtctgaatcccagaagcctttcttgccacatgatttccactgaaccttatattcccaggcaactcattgtgaagatgcccaccccaccactggatgattccttatggagagctatagagcattcctagctttagcccagatggtcactttctcctctgtgcatttgagcagcaagcaggcctctctccagcatctacaggaaggaagtctccttcagctgatcaaatcatggtgacaacagcgccctctccacttgccaaagtgaaacatctttgttttcagggtatgtgttcctgctagtccagtgtcctccattcaagtgagtccctctaggatgggtaatggcagtgaactgatcattttcctcagatcttgacatgttgattaaatagctgtctggtgtttaaaagctgttgatgttgcttatggctgtggcttattgtagaactagatataatgtcctggatacactggaatgcacatctgaggacttcattcaaggcaggagaagccatagtaggtgggtggcccatggcagatgagtccctctgtgtagtcaggtggtcaccttacagtttatgcagtcgtcaacactaacggtcactctgaccttgtaaggacccgggcttctgggctctttcagactctgtttcatgcctgaggtggagtttggaggttgaccctggatgagcccctgttgcaagctctctgcagagtcaaggggcatgggagagtcagcaggaggcactgctatccctttaagaattgtgctcagctgtgctcgtgggtttcagaggaatcgtggggggccacagccagcatagcttcagactaatgcatcaccctgccagatcccccttccacacatgcaaggaattctacactcaggggaggtggggaggcagagagaatcactgttattgggaaggcatgagcccacccatatttaggccttttgtgcatttctaacaggagggagggaaaggtgaggaaggagtctctctggcctgtatcctgtggtcaggacagcactggtggccagtgtcctattgggagtgtgaaaactaacgcccaagtgggcaaggacagaggccggggtgactgtggctgccaaccaggccagggatcacaagcagtgtcagggcaggctggtgccagactcaggtcaagactgcagaaaacttcatgtgtgaagatagacaagccccagagtcaagcctgagggcaggagacttggagggtaaaggcaactttttgttggctttaccgcaaggcctggttatcaggctcgtctcccacctagagcatcttttgggaagcaaagcattttgaaggcccaggtctcctgttccctttatgtgatagatcctacatgatgtagcctatgggagatggcctgactccttagagagtacctccgttactcccaaaataggagtctagaaagagaggtacttctatcaacatctaacacatcattttcctaatcctcagattacaaagtggcagctcacatacctaatctggacagcagatgagatcattagaactacaatgctgtttttaaggaaaattattttgttgccaacattgaaaaatctagatctttcatctgaaaatctcaatttctgggtttccttagaaaatcaaaatgtctcggtatatatgtggctacagttagatagaaataattagctgctaccccattaagacgagatatttagtttcctacattcctcatgatggcagtggtggcccatctggggtggccgttgccatcatgccagctgcagcagggagccatgaccagggctgcacactttgtggagctggtgggagctggggacaagtgggagccctgtccctttcaaattggtgtggcagtagctccccggttgcagccgcagctgcccgagcggtggttgtggacccaggcctcccactccatggagcaggcaggagtcctgccctcctggacacagctgcagccatccaaatcgcggctgcagacccaggcatccctaccctcttggaaatgtctgctccccctgcttggctctccctgctgtcagtgcccactccaatctcaaagcaaagtcagggctgatcccaggtgctgtcacagccaggtcaggtgtgcacatgcttggggcagtgctgacacaccagttccctgctgccttagccccctccagactttgggctctgacaagcttaggaagggagacaatggggggccaaggacagctcagtgctggcctgcagatatcccctggcacctacagcctgggtgccatgaacggcagcaggaggcagacaggttcctaggtggaaggtccacattgaggccccgagttcaggccaggaagggcctgaaagctgggggctggactgcagtcctacagactggagcgggaatgtgttgtgctttatctgggcccacccatggccacccgtggaccagtcagcatacacttcctcccctctgaggcccttaaaagccagaggactcagccagagctgaacaaatgttgggaccaccagctgcagagaggagctagccaccccaagtcctcctctctgctgacagctgggaagatgacaggaagacctgcctacagagaggagcttcccactccaaggtctcctctctgctaggagctgaacactcatcaggacacccttgctgcagaaaggagctgccccctgtgggagactaagctattctattgctcagtaaagctccccttcatctttctcaccctccacttgttggtgtacctcattcttcctggtcacaagacaagaactcaggacccgtcaaatggtggggctaaaagagctttaacacaaacaggttgaaacatgccccttgctcgccatgttgcaggcaaagagaaagagagaagagttttggcccttcggggagcccagacctgagaactacttgagcaagggctgtcactccctctttggggctctgtggttcactggcatctccaaacttccaggtgccaccatgtttcccggtgccagctgtggaagctgcttgtcgtgcgcctggtccagtggcagcctcacagagagccggcacctattctggcatctggaactgcctgcctgccctgttgcagcagctggcatgtctgactgtgtgcagtggctgaaccccacgcttcctcacacaccccttgccgttccacaccttactcccccttgacaggtgtgggacccaggctggtaacatgagccaagcacagcctgccaggctgagtgggcacagcgagcccagcaggaccgagcacaactcagacaaaggtgccacctgccacagagatttctggccagaaaaacgacaccctaaagatctcataacacttactcttccctattgtatccgattactgactcatccctttccttaaagtacctgtctggcttctatagatgagttcattattctcactgtaatttaaatctccaactctaatgttcagaaggattccttctctaattactatagtgcagtgcagcactcctcagattatttatggtgtaaagccactattttctatttttcatgttctatttaatttagagatgatatgtggtcctattgtgcatgactactgtatggctcaccattgaatcatcactggagtttaacaacagtcagactggtatacaccctgtccaataagatgacttcactcacttaaatgtgtgacgaagacagatttctataaaggatcctgaatggtggtattcaattcctgtacctgttgcagccaatcagtaataaaaactttgtagccgtacactgttcctaaaatcacagtgtgtgtaacactggaatggtgaatttattgtattctattattttaggagtatgattttaaatgtaatgaagggcaataaatagaatctgcatttggcattttcttaatgtgtgtcttccaaaggactttatgagagtagaagatttgatcctcttaatgttctagaataactgtagggaaatatctctaacttattaaagcaaactctagtaaaggaaaccagttagcatcaaggaggcaggttacataccatggttgggagttatttgcattctgaaatgtaggatgaaaataattcatcagctcaactgtgaaggggagtcttcatgacaagaaaggggaaaatagtgaaaggaggggcagaagagctgacttctggtcccctcagtagaatttacttgggggaccatcagcttctgtggctgtaaaatgaggttggaaaaattatttcaaaggtcttcttgaggtatacagttatcagactatgctcttttcctaagaaagaatctctactgaaaatgggtaaaaggggaccagactttttttctaagttctccattttacagctgaggtcactgtggcccaaagatgataatcagctctttcaaggtcaaagcagggatgagagctggtcatcccacctgttgttgaagctctttcctctcctttatccttagaaatagcgctcaagatagaaggtgcttaatgttctcttctgggaaagtgaagctcatgtgttcaatgccaagatgttggggtcgcttggatttctaggaaagcactcacaacaacttgtgaggtctcattcttgatagtgagtcttgacaacactctcacttaacaactcactctcgagaactttcacttgtgttttatttggggaagcccagacaggttgggaaaaaagggctgattttataatgcaggtccttagacttcgaaaacctaggtcttgttccactggacgttgtgtaactgtgttgtgaacacaaatgcttctcagttaaggttttctggaaattctgactctatccactgacattgtcttaaatgtggttatggggtgatatgatgagcccaagcccaaaagtctattttttgaaaaattttatgggtacatagtaggtgtatgtatttatgggttacatagaaatgggaaaagttcccttgtccccctcacagggcatgtgatggacgtgtggctcacttcttcagtgccctgctgctcaaacccctagcgggagcatgcagactggtaggttgtggggctctgaccccatggcggtatctaaaggtgaatgtttacagatgaagcctcagtaggcatgtgttacagtatgctctttcagtttagccatctgtaggtagctcgtgttagtcagctcaattagacccactgccttatcgcaaggacagagggctttctgtatcccagggtttcttgccttggtgtactggaagaatcggatcacacatgggcttggagaacgagtgcgaggttttattgagtggaagtagctctcagcagatagcgaagccagaagggagatggagtgggaacgtggttttcccctggatccaggcccgctcagtggccgggctcttctccgaccgccccaaccgaactccgcattgttttgctggtcaatggcctgccaacctgccagcatctgccagtgcctgtcggtgcgctctgccagcgtgctcctcttgatgtccagctgcttgtttctctgcccgcgaagatcttggggtttttataagcacaggataggggtgtggtgggccagcgtggtcttgggaaatgcaacatttgggcaggaaaaaatgtctgtcctcacctaggtccctggtcacaggcccaggggtggagccctagccacagaccacaccctcccctacccagcacttccctgccctcctcccatatcaacatgagatattttgatgcaggtcttcaatacgtaatcatcacatcagggtaaatggggtatccatgacctcaagcatttatcctttgtgttataaacaatccagttatagtttctttgttaatttaaaatgtacaattaaattattttggactatagtcactgttgtgctagcaaatactagcatagaaaaactagaaagaattaatgtcttatttattctttctattttttgcacccattaaccctcccaacttcccctccagcaccctactacccttcctggcctctggtaaacatctttctaccctctgttctcacgagttcaaatatttcaatttttagttcccacaaatatgtgagaacatgtgaaatttgtctttctgtgcctggcctatttcacttaacataatgacctccagtttcttccatgttgttgcaaatgataggatctcattcttctttatggcttggtagtgctccattgtgtatatgtaccacattttctctatccatctgttgatggacatataggttgttttcaaatcttgtctattataaatggtgctgcaataaatatgggagtgcagatatctcttggatatactgatttcctttcttttagttatataccgagcagtgggattgttggatcatatagtagctctattttgagtttttttaaatatatatattttttactatactttaagttttagggtacatgtgcacaatgtgcaggtttgttacatatgtatacatgtgccatgctggtgtgctgcacccattaactcttcatttaacattaggtatatctcctaatgctatccctccccactccccccaccccacaacagtccccagagtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatcaactcattggtttttatggctgcatagtattccatggtgtatatgtgccacattttcttaatccagtctaacattgttggacagttgggttggttccaagtctttgctattgtgaatagtgctgcaataaacatacgtgtgcatgtgtctttatagcagcatgatttataatcctttgggtatatatccagtaatgggatggctgggtcaaatggtatttctactctagatccctgaggaatcgccacactgacttccacaatggttgaactagttaacagtcccaccaacagtgtaaaagtgttcctatttctccacatcctctccagcacctgttgtttcctgacttttggatgatcgccattctaactggtgtgagatggtatctcattgtggttttgatttgcatttctgtgatggccagtgatgatgagcattttttcatctgtcttttggctgcataaatgtcttcttttgagacgtgtctgttcatatcctttgcccactttttgatggggttgtttgtcttttttcttgtaaatttgtttgagttcattgtagattctggatattagccctttgtcagatgagtagattgcaaaaattttctcccattctgtaggttgcctgttcactctgatggtagttttcttttgctgtgcagaaactctttagtttaatgagatcccatttgtcaattttgtcttttgttgccattgcttttggtgttttagacatgaagtccttgcccatgcctatgtcctgaatggtattgcctagtttttcttctagggtttttatggttttaggtctaacatttaagtctttaatccatcttgaattaatttttgtataaggtgcaaggaagggatccagtttcagctttctacatatggctagccagttttcccagcaccatttatcaaatagggaatcctttccccattgcttgtttttctcaggtttgtcaaagatcagatagttgtagatatgcggtattatttctgagggctctgttctgttccattggtctatatgtctgttttggtaccagtaccatgctgttttggttactgtagccttgtagtatagtttgaagtcaggtagcgtgatacctccagtgttgttcttttggcttaggattgacttggcaatctccttaagctgataggcaacttcagcaaagtctcaggatacaaaatcaatgtacaaaaatcacaagcatttttatacaccaataacagacaaacagagagccaaatcctgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatatatatcgtgaaaatgtccatattgcccaaggtaatttatagattcaatgccatccccatcaagctaccaatgactttcttcacagaattggaaaaaactactttaagttcatattttgagtttttaaaggaaccttcaaactgttctctagagtggttgtactaatttgtattcacaccaacagtgtacaagtgttcccttttctccaaatcctcaccagcatttgttattgcttctcttttgggtataagccattttaactggagtaagatgacatctcattgtagttttgatttgcatttctctgatgatcactgatatttagcaccttttcatatgcctttttgccatttgtatgtcttcttttgagaaatgtctattgagatcccctgccagtttttaaatcagatcattatatttttccctatagagttattcgagctccttatatattctggttattaatcccttgtcagattggtagtttgcaaatattttctcctgctctgtaggttggctcttcactttgttgattgtttccttgccatgcaggagcttcttaacttgatgtgatcccatttgtcactgtttgttttggttgcctgtgcttgtggggtattactcaataaatccttgcccagtcaaatgtgctagagaggtttcccaatgttttgtttttgttgtttcatagtttgaggtcttagatttaaatagtacaatcgcatggagaaccgtttgtaggttcctcaaaaaattcaaaatagagctaccatatgatccagcaatcccactcctgagtatatacccaaaagaaaggaaatcagtatattcaagagatatctgcactcccatgtttactgcagcactatttacaatagacaaaatttggaagcaatataaatgtccatcaacagatgaatggataaagaaactgtggtacatatacacaatagagtgctaccatctataaagaagaatgagattctgtcgtttgcaacaacatggatggaactgaaggtcattatgttaagtcaaataagccagacacagaaaaaaaattttgcatattctcacttacttgtgggagctgaaaatgaaaataattgaactcatggagatagagagtagaaatatggttaccagaggctgggaagggtagtgaggtgctggggggaagtagggaggattaatgggtacaaaaatagaaagaatgaataagacatagtatttcttagtacaacagggtgactatagtaaaaataataatttaattgtgcattttaaaataatgaagacagtatgattgtattgtttgtaacacaaaggataattgcttgaggctatggataccccatttaccctgatgtgatctttatatattgcaagcctgtatcaaaatatctctgtaactcataaatatatacacctactatttttccataaaaattacaaataaaaaatcctaaaactcagcccttacaagatctgcaggggagacagaatttgtaggttgatctcccaaattcatcaggcttggaaaggaccttagactttctgcataactacattagcaaaaccaaaccaattctatggaaatgccaatattaatagaacaaatattaatactcctcagagggagatagcagagtctttacactatatgatccccattgtccaatatgcaataaaaaaattcaacatgcaaagaaacaagaaaatatcacctattgtcataaaatcagtagaaacagacccaaaaatgtccagttgttaaacttcatagaaaaagactaaatcaattattatgtattcaaagaacaaacagaaaataggttcaaagaatgaaaggaaaatatgatctttataaatgtacagatagtgaatttcagcagagaaatggaaactataaaaataaccacatggaaattttagagcttaaaaaattatagtaactgaaattaataacacactagatgggctcacattagtttggagatggctagcatcaaatgagcttgaagacagatcaaaagtaatcatccaatctgaaaaaaatggaacaaaacatgtatctctaaactttttaaaggtgttgtattgacttcttttgtatgagttttttaacataagaaagtaataactctcttggtacttcaagctagactcacgttttcgattctccaggacaccacctttggggttccccactgtagctaaaagggacctggctatggtaacataaatgggtaatcaccttggcagaagtgatcttaacaaaaatttcacttacttcaactaaagattcagtaccatacaagcactgagaaaacctcactcattctctaatgttcagctgagcaatcacatactgttacacatttgtcttctaaaagtcatacatacatagcacagtgctatgattagatacctggactatggttatggagtgcctggatttaacttttgactccagtacttactaactgggtgactgtgggcagactacttagtttgttcatttgtaatatggggataataatattatacacctaacacatttggagaattattggagaggatatatgtaaagcacttacaacagtgcctggcacatatgtgttcattgttatcacgtttctcccaggttttttaagaatagagattttcaggggtagaagaatattaaaagagtgaatcacctttaaaacactggtgtaaaaaatacctcatgtcaaaaaatgtttaaaatgtgctttagatgaaacctgttacctttcccctgctgatcaacagagacattcctttttgaaagctcagctttagagatactgccttcttcttgaaatagctgtctgcaacagataaacattactctgtgctactgggtgtgttcaatgtgtaaatagattgtgggaatatgagaggctggtttttcaagttcctgctccaagtagttcacaagggtcaagtagtccagcattctacagtttgtgtgtttgagagaaaaataagcccataaaaacattctaaccttcagattaaggtaagactaatgcgtttagggatctccagtgtgatatctgatttcttaatttctgtattttgtgtgtggtaggggagtagtgggatttgctggtcaggaagaaaacagctccttccaccatttgatattgtattttacagtaaaaaagggagaaatatgtacagaagggacattttggccattggtagctatgagtttaatggattgaggagagaaatataagtatctttttgttattaacacttgattctatctatgaagtgaagcattgcactaggttctactgaagagtgagtgcctccaggaacaaatatgcattctagtgacataaaaaaatcaaattcacagcagaagtgttgcatcattttgctataaatctctcacacctctctatataaacctctcacatctctatataacatagattgtccttttgctctgaatttctttcatttattagaaaatttagatgtttcatttggaattatttaattgtttttacattcagttccatttttgatatggacaaatatccagtatggatataaattcagtagaaggattaataaagtctgaaaaacctggaataatttcaacatgaatatgatactgtaacagcttacagaaatgcgatattaactgtgaacattaatatactctgaaaagatgcatcagggtttaaaaaatttctccttaatgtagattgttttaattaccaatactgtcttcctcatttaaatgaaaaacgtaattttacaactattaatatataacttctctttgctccaagtatatgtgtatgcctggagaaaagcatatgcctggagaaaacaggagttatatatttatagcattcaaaatagtataaaatattgtttacatgtaataatgcatttagaagtactacttcagtagtagcctccttaaaaagtattttaaacacaggaattaagtatataattttttcattttgtaataagttgtttatatgttatttggacaacagcttacacacaaaagtgttacaattcataccctaggtcttaaatgcatgaagccatttgtttggactctagtgaaatccttaaattggtccttgcatccctcagtatatatatgtacatacccacatatacatgcatatttacatgtgggcaactaataactgagaaaatgtcttactgctcttttagttgttgaatcatgctttttctatgtatttatgatttcctgaaattctttgctattttaagtttgggtattagctatgttatccttctatttattcagatttgttaaagtcttctgataggtttagtgaataaaattattgagcttctacctcttttcttttggaggcccatttagtatttttgttgaaattacttccttattattatttagtatgttaagggaaggaaaaggaaatgtagctttaatatgtaaaatgagcagttcgttttacttaagctctattatatgatgatgtatcttatgactattttgccatcctgcgtaagcacttagctaatcatctttaatacattctacttaaaatctacttgtaaatatgcttttgtacattcatatcttacttgtctgtggtctctcatcctctttctctctcacccctctatatacattcacacattttccatgatttcacaaaacttctctccaacctcgttccattcctggttatctctttctgtggggagtatcatcatttcctttgacctctgtttctctacatcttccatcttgcttagcccatggacttttgattttactgaagacagcaaaaaagcagatggtgcttctgttacttgcagagttagcaaccgctgtggttaccttaggttctgaaagattatctaaaatagggaggagctcctagaggaacaaaatataataaacatgtagtgtactgggataaaaaattcacttgatctggtctctctctccttttaacaaaaacatttctctaagaagtgattaataaaacataccctactgcctcactttctcttttaaaatctttctttcaaattcccctatgacataaaatcaatcttcatcactttattgacactgtacttccaagggtcacctgtagtgctgctaggaaattcaagtacattcatttatttatgtattcattcatccattcaataaatatttatttagtgacagctatgcatcaggcattgctgagcactgaagttacagtagggaacacttaagtctgcctttatatatctccagtctagttaggaagggtgttaactcacccaaataattcattacaagtgtgataagggctataaggaatacttttccaaattctcattttattcatccccttggctctatgtgacacacatgatcaattcctacttcttaaattttctctttccttcttgtccatgactctatactatttattcaactgcttttctaccacttcccttcttgtctatttttccttttctcttccttaagtttgggtttccctcaaaggtttagcatttatttagcctataacctattacgttttgcctttctctataacttcttatcaacccttagttttaaatatcacctctaagtggatacctccaagacttccatttccacatcttatcttttccatctgctatacattttcccacttgtatgtccaagggtcactcgacattcatcatgattgtagccaaactcacagcttttatgtcaaaccacttcccctttcatttcatttgtttctgtgaatggcattaatgatctcttggtttctcacatttgaaatcttggagtcaattttgcttctaacttttcctttgctctcaatatccaaaccactaccaagtccattcatttctttaattataatgtatctagaagccatcctctctcatctcccttttctgttatttttttcttttattctctattttctcatccttttttccctcagtctaagagctacctacaattcaaggttttggtcaggccccatctccatcagaaagtccacacctcatggatatcttctttttctaagccccagaatcattggggtagtgaaaagaacatagccaaagagccaggtttaagttttgattctaccattcactgccccctgtgcactctctgtgaaccacagtttcctcagactcattctatctcatatagtggccacaggaacaaatatagtcatggagaggaaatcattttgaactatgaagaactatatagatattaaagtaagatttgttgctggaagaataactcagtagcagagaccaaaaccccaggtcttaactattgaaatcatattgtgcaggggttgagagtgttgactctgcagtcagatgacctgagtttgaatctcagctctgctacttaccagctgcatgaaattgagaaaacttagttagctttcctgttgctgagtttcctcactgtcaattggggataacaatagtttctactgataagagtgttgtaggattagaacgtttagtaaatgtaaaatacttaaaatagtgcctagctcatagtaagtgctctgcaaatgtggaagaggtggtaggggcctatgaggctaagtgtggttacgaggtgaaagccaggtattagaactgagccaccagatggggattaggtacagcaaggatgcaagcacagagctacagactggacacatgtacctagatgaatccctcatgattcagataaaaaaaagaatgatcttgccatttggggcagaactgagcaaatgatggaggtatgaacgttctgagcgaccattcggggcacaaaaatggggataacagtctttcagacacattttctttttgttaaagaagaacaaatgttagattgcccttttgtgttgtgaaatatgtcagtatatcatggaatcaaaatgtcagtatccaaataaatgtccaaatgttgagaaagctgactcaactgtcctctatattctagaaatccgtctctttaacagtcatatgcttattgcatttcagaggacaagggcccttagaaatgtcattcctcacaatttataggattattgcccaaagtgtgtatttttactaatacacttggagattagtttgtttgattgtttcatgtcagaaagaaaaataataataatacttagaatattctaagggttgttctaagtgccttaaattttttaactcatttaatcttcacaagaacctcatgagatgaacatcatcatcatcaacatcatcgccactaccatttacataagaataaactgaggatcatagaggttaattggtaattggaccagatttcaaatccaagcagcccagcaccagaggcaattttctcaagcactgagtgctatcatatcagcaactctgtgttttagaatctggttaaaagggcatgctctggagtcctagactgctgttacatgttgcatctccagttttccttgacaagtggtaataaatgtttgatatttttcataattgataaaaattacttacataagatttatactaagtaatccaatgtccagtaatgctgtgcaagaagagtctggtttttctcatccattattctgtatttgagcatcaaacaaaggcctcaaatactgatgctctctgtttcctagagagtatgttatactgctggccgggcgcggtggctcacgcctgtaatcccagcactttgggaggccgaggcgggtggatcacgaggtcaggagatcgagaccatcctggctaacatggtgaaaccccgtctctactaaaaaaaatacaaaaaattagccgggcgcggtggctgccgcctatagtctcagctactcgggagactgaggcaggagaatggcgtgaacccaggaggcggagtttgcagtgagccaagatcgcgccactgcactccagcctgggcaaaagagcgagactccgtctcaaaaaaaaaaaaaagagagtatattatattgttttgccctgtacttaactgatgttgtacccgtgtacttaactgctgctgctgcccgtggggatattttctagggtatctgtgagtttccatctttgtctttgctaactatttcaaaagttcaggctcaatttttggagttgctatgtttgttttctatttcctattttaactacttcttgttcatttaaatgttctctcaccgtagtttagtgggattttttttttttacttttctctaagcgttagctacaaaaataacttaataggcttttagttcattttcttcttcactgaataagaatattaaaatcaaatttaccttcaccgaacacttaataacttttttcatttccaagaaggcccagtgccatttgtaactcttgttaaagtttaatttagcagtttccaatttttgtaacagtcgacttatccaggctaatttgatttaatatttctaacagaatgccaggaaacactctgttcctacaataagaacatgtctgattcatttaaatgaataagaacacgtctggttcatgtaaatagacttcagcggcatttttgttttggtgttgtgcagtcaaaaaatatttccgagagaatatcaggacttggaaagaaaccaagaaaatgaatacaaaacaactctaagatacatatcattctaaagcaagtaaaatcctcaagaccaaataatataatttaaacaaccatttaacattgataatgtttactaagaatggaagtggtagactttaccagaaaatatagttgagttggggtgggacgtgggggtgtgcaatagagaaaccaaacttggaaagaagccatcagataatgatgttccaggttcaaatataaactttaaatccaaatatacttttatctggattataaaaacgaaagttcagcaacagcccactttgtaaacacagaacaagagtgatcatatcaaacaggtttacttaatacaaatagcagagtatagacaaatccattaatatatccccctaagagctatttatgtacaacaatagtcttctctccctggtgtgaagttacattaaaatcagtatatgattaaaatttttgaaattgatttcattaaatcaagtgacattatatcaaagatcagttttcaaacaaagcagtaagagcctattgcaaaataggcatttttcccaactttcaacagataatggtatatccaaagatgtctgtggccacaaacaaatgtataatttttaagttgcatattttgactagaactagatatgtactaaaaaaccattttgtgatgaagaatcacttcccactaattgagagaccagcacagggagaatactattgatcttaaatacaaggaagtccagacattaatatggaaaaaatatagattgggatgtcctgtttgcattagccatgttcaagaaggaagaatttaatttgctttgaactactcacagctgccatctaattatttttgttgactgttacagagtttgagctccaaacacaggaaggttatttctaaatcagttatacacaacaaccaaacagctattgattttctttcaagtgaattcccatctgactcttattgttcttgtgaataatagtcatatgtatggctttatacttaagcacaataggatataactaaatattggctcaactcagacctaaagagtaggttcctgaacagtgagaatatcatctagtgataatctttcactgcttatactgggaaaaatgttgaacctgggtcagcaaacatgaaatgtaggttcagtactgctcctaatgataatgccaaaggctcacactttctgaggatttaccgtgactcaagaactattcaagtgttttctatgtaaccaaggcatacagaggttcagtcatgtttctcagaaattttagagccaagatttaaaccagagttcctgctttgtaccagagtcactttggtcagcttaagtaacttccaaaggcatcttcctggggtattttttcctgctgcaccaatttttacctttcttcctgattctcaggctcactcaatctatactggtatctgcgaacctgtcactgacctcaccccatctccagcatctcactgattggtttcctctccatgatcttttcttaaggggaccctgcattctttgggcccctcatcattactcaaggcccctagatctactggccccctcagtcctcctagtccctcaaccaccaccaactcctcctctcctagcttagctcccccattcctgctcacaggagccaggtagcatcaggacctccccaatctcattttcctctctaccctctccacactctgactactgtttcagcttttatttctttctttagtcagggcaatctgctctgatgtcatatcctacatcctctctacactgtcataataaaactcttttggtatgtacaagtgtgtaccctccaaagcaggagtgctgggcactggtataaatttgaccaatacaaaattaaacacacacacacacctgtgtgttatgttgtatattatgttatatataatattgttgtgtgtgtacatatatgttatatgtatgtatatttaattctacagtatattatagtggtcaagagcacagtcaatagagtcagaccccttagtcagaatccagcttcaccacttacaagctgtgtaacactggacaagttacttaacctccctctgccttggttttcctacctgtaatatgggaatagtgaaagtatctaaatcaaataattgatattgtaaaccaaaaggtatctgagacaggtctcaatcaatttacaaagtttattttgccaagattatggatgtgccagtgatacagcctcaggaggtcctgacgacatgtgcccaaggtgattgggacacagcttggttttatacattttagggagccgtgagacatcaatcagtataggtaagatgaacattggttcagtcaagaaaggcgggacaactctaagcagggagggggcttccaggtcacaggtagataggagacaaatggttgcattcttttgatattttgataagcacaatttacaggaatagtcacttatgccttagtctggcttagtgaaaaaacagggcaaaggaagcaatcagatacacatttgtcttctgtgacagagggatgactttgagttctccctgtcctttgtccacaagaaatttccctgtgagaaaaattgtgagggaggtatgtagcttttttatctttgtaggtatcttatttaggaatagaatgggaggcaggtttgcccaatgcagttcccagcttgacttttcccttcggcttagtgattttggggtccagagatttattttcctttcacaatgtaaagattgtactgttcatatatgtaaatcaagaattcataacagggcctgaaacttgtatataagtgctgagtgttcactatcattattaccatgactcataaggaaaaagcattaaggcaagtataataatggagcaggaaatatacatttaagtggaaaatatagtacaacatggataatatgacatgtgtgattaattacgacttgaataatgcgaagcatgtaattatttttggctttgcatttgatatctgaggaatcccaccatttcacatgaaaaagtgcatgtgacaaggaatcttccaggaattttgcattagaagttccttttgatcctcctcaaaaccctgtgaagttagtactattattatctccaccctgtatgaaaagaaaccaaggttcagagaggttaagtaacttagtttctgtaacatagtaattgccaaagctaggatttgaatgcagagcttcctgactccaaaacctgactctttgcaattctccacttgaggtgtccattggaaccccataggacgttaaaaaaaatccatggaacacaaactcaagagattctgtttttttgaaaagcagcttttgtgagatataatgtacatactgtacaattcacccatttgaagtgtacaattcaatgtttttttttttttagtctattcacagtgcgtttagccatcaccacaatctaatttcagaacactttcgctctgggcgggcatgtccacagaatccctggggtcttaatttcaaagccacagaccttgtaggagtcttgaatgaacttcaaatgatttgtgaactttttctaggatccacagctttcactatcttctctaaagtgataaaaatataagccaaaaatgtattaagaaactctagaccagaatggccttgaactttaaggtacaaatcactgggggaccttgttaaaatttagattcaaattcagtagctctggaatgcgctaggcctactatcattaattttaatgataggaatgctcactttaagttagatgttatgtgccctaaaattccattcttctctttagtagatctatgctatgaaataactgcactcaattattattgttatatttttaatgtcatcggtaaaatattggcagacatttattttcttgattgatgcatacttatccacaaaatagctatggttttggctcttggcgcaaaaagtctaaaatatttactaattgttccttaatagaaaaagtttgccaacctctaatatagaccatgggggaaagccacctttaaggagcagaaatgttgttcatcttactctccacagctccttgctacatgtggcagacatgacattatcaatcagacttataggaatcctaaccaagtatgaggggcagcaagctggctatatttatgtataactcctcctctagaggagaaatctgggcagatgagggtcaacttcacttttagtttaaaaatacatctccctagagcttcaagctgctctcctgggtgatagcatgggtgggtgtccacaaaagaccttcatgcattttcagttaggtcatgtctctatgatcttggaagcaagattccctaagagtagtctgcaatccatatagagagcttggttaattgggtttggatgatggttcaccaaacgtacaggtagaatattttatcttcttacactcaccttcaagctacttacattaaggtgtttgttcagaacattgaactttcaagagctgtctgaccatgcatttcatatgtatgaaggcatttctgcttattttccaacactaactcactttgaatgctgcaaaaatgatctatgctatgttaatgcctgaatatgcatgacttcaaaattctccaggcttcaggtggtctcctgcaccataagcctctactgcagagcatcctcttagacatccatcttgaactattttttccttatgtcttagtctatgactttagatctcctaactaatggttgatttttcagccaattttgttgttgttgttgttgttgttttttgatgcgagaggttgcccattctcaaaacccacttccttcttccaaccaatgcccattgctacaaggcccgcaactgtgttcagctttcagcatgctccaggggaacaagtacaaagtctgacctggatggaattagattatgcaccaaaataattccaggatttactaatttatatcattagaaacctagaatgttaggccaaggaagatgtaatataacactggattaggccaaatgtattgatatggtgcatttttcagagattctggatttagtgtgatacttcttgcagctggaggtgttgttaacagtttacttgattgtttagttgaaatgtgaacttagcaatgacctacatcattgactctgtgtgatatacttgactcccagttcattagacttaactaactgctcctcccattctgttgatcatccctcttcagtctctttcatcatctcatttattcctcttgtccctggaccaaaccgaagatcaggctgcttattctcatggcccgataacgagattcagataagctgggaaagaaggaagtttatttctgtaaccggctatggctgaaaaatatctccagaccaactcaaaattacaaagttttttgactttgtaattttgagttggtctggagatatttttgacaaagagcttatataccttctaagctatatgtctacatgtaagtgtgcattcatctaaagacataagtgatttacttcttctattctataactaagatctgactcctaaagaccttcctctggagcctcagtaaatttacttaatctaaatgggtccaggtgccggcggtgattacccttatcttgtctcctgctaaatcatggaggtctggggagttccttcagacccccaataaacttgtttgtggaggtctggggcgtttcttcagacccccagtaaagtttgttttatcctaaatgggtcctgttaagaattccttcattatcttgccatacttcaaggcccaggaaaggcctgggcaaaactcttggtgggcttttgttaccttccagcctttgtataagggcactggctctatcagcttttaatatttaacttcaccactcagtcagtgctgaaacagttgttatggaggcctgcgttagtgagacctggcctgccacactctgtccattctttaaatattgttgcttctcatgattctatcttttgcccctttcacttctcttcctggtaatctcacttgcttgcacagcatcaaccaccatccaccatcgaggcaccaatgattcccaattaaatacctctagtatagacatctgataagctataaacagtttatgggaagtttcctattctaaatgcctttctggacaggtctttgttgttgcatcataagtacctttgttgttgcaccataagtatccggacctcaacatatctaaattgcaattaattatttttttttctctttcaacgttttttgtcttgtactctccatcactgtgaacagtattatcatcaacatttctaggctttacccccgtgttactgaatcaggctctctggagatagacacccagaaatctatttttaacaatatacttaggtattcttatgcacactaaaatttaaaaacctttgcagttccccatgctggaaacctcagagtcattctcttttctcttccataccacccacatcgaagaggtcactggatcttattgagattattctaaaacgtcccaaaagtgactcttattttccttcccactacacagctttagttcctaatctctccctggcacttctgcaagagcctcctcattttgtctacctgacctttcccctgtctttcatccaatcactgagtgctggtctttcaaaaaacaaataaaaaattcaaatatgattgcgctgttccttggctttaaagcttcaacagcttgatggcatgagaacagttttcaggcttcttaaggtcatggaattctttcttcaaataaaatcctaccaggaaatctaacttatagaacagatgaaaacggagctgctctgtttgaagcagtcgtcggcgccacaggcttggccactcagcctctttcgctgtgtttcctaagaaaacattcctgaagatacagtttgaaaaacactggataaagtccatattctttgtttggatgccaaattcctcccactctgacatccccctttctcttagctttccaatattaacccagaccccagacctggagttagtcactatttcttctggactagttgtgtgttcttatgactttttcacatttgctgtctctacaacctagaatgaccacttttttcttcctaattgttttttcctttgtgttctcaaagccaaaattgggatttatgaaactgtgattttatgtttatgcttgtctccactagaaaataatagaaaatagagaagccccttgaaaacagaacctatgcattcttcatgaatgtatcccctagatccagcacagtttctttttttgttttttatttgtttgtttgtttgtttgagacaaagtctcactctgtcgcccaggctggagtgcagtggcgtgttcttggctcactgcaccctccacctcccacgtggagggtgcctcagcccgggtgcctcagcctcccaagtagctgggactacaggtgtgtgccaccatgcccaactaactttttatttatagcagagatgagagctcattatattgcccaggctggtttcgaactcctgagctcaggtgatccgcccgcttcggcctcccaaagagctgggattacagacctgagccacaatgcctggcccaacatagtttctgacacatgattctatacgtgtttactgcacgaacatttatatgctctataactcattctatctgttctttggttttatattttcttcagaccgaacatgtctttttgaattaaacatcactttaggaactagatgtattaacttcaaagctatatgacactcatactgttctttgcctgtgttgtagcctagcatgataattattgataatcagtggatatatgcattgtgcatcatgacatatgaagcagaggtaatatggctataagatatttttgacagaaatgccatttgctgtatttttttaactgattttatatgtaacatgtattcattgtaaaaacatataaagaaaattataaagaagatattaaaatacatttataactatccagaaatagacttaatattttggcttattttttctcattctttcttctataatacatatatgtgtgtgcatatatatatatatatatatatatatatatatatatatatatttcttttaatataattgggaccatactgcataagtaattttgtatcctgagtttttttcactgcctttgtattgtgagccttcaagcatgccatcacatataaaaagactattagtattattaataatggtattaattaaaaattatgatgtttctaaggaattgctaagatttataaattcttaatagaaagtctaggaagccagagacctctgggtattttgtgaatcaaagggaatggaggtttgtgttggactgatgcattttaatgacgtattgcttaacttcattgagaatagaaacgatggaggggtctaaattttctgagcatctgttatatgccaggcattgtgctagacactttttatacattaactcattttaatattcaaatgatatattcttcaaacccaggaagtagatattaatatgcccatttaacagatgaataaactgagatgcaaagacaaagtagcacatctatgttattatctcagggagtagaattttaattccattagtttccaaagcccataccctttcctctaccccacactttctccaacaccaactttgagagggtacacaaagtcagtcttttattctgaagatgttgtattagcagtgcttaccctgtggaccataagcccttgggtgaccacagtttataaacccctgaaattacctccctttgtcattagaatgtatatgtatatttttgaggtagagagcctatagttgtcactgattatctaagggatcaactgttcccaacaatgtttatgaatctctactgcaaataatgggatgtatacaagtattgcagaagccctttgaggagtctttagttttgcttgtcaggccctgtggtgaggggctatattccaattttcattttaggcatcacttctcaaatgtcttattttgcatttaattcataaatttattcatttggcaatattttcaaatacctactatggtgccaggagttgtgaggtgttaggaatacagggctgatcaagacaaaacgagatatcccacagagcttagacattagcagggaaaaccaatgcatgttggttaaaatcagcattttaaatcagcatgatgagtgcttggcatagtccttagcattgttcaccaaatatttacgatttcttcctcttgtaggcagatggcaggataccatttactggcccccttgtaattgggtagggctaagtgaccatcagttctgtttaaggagttgtaagtagaaataatgtttttcacttccaggccaggacatttaattcctactatgaaacctttcagaactcttttttccctctggtgtggcaattggcagtgttcaagatggtagctccctaaacagcctggattcttgagggatatatagcatggccaagaaatatgaaataaacctgtgctgttacaagctgttgcaatttgcgagttatttgtgtcacaacatagtctaccccagtactgctcaaaatgtctgtgatgaaggatcaggttgtttgttacttttattttcaacctggatagaatagtatttttgcaaaatacaatttaagtaaattagcagataaatgagacatgaaatacataaacattcaagtacaaattttcatcagattcaacagatttaaaattactctgtcaaattactataaaaatttctaaatgcttattcttaatttctttacttatataattgcaaaccagtaagtttacagacctgcactggtttgcaacccaaactttgaataaagctgtattagcctatcccaactgatacagtgttactgtaagagaagtatgaaaatgtattggatagatactatgagtttccaattgctgctgtagccaatcaccacaaacatattgtcttaaaacaatacaatgtattatcttacagttctgaaggttaaaagtccaaaatgagtcttgggagactaaaatcatggtgttagcagggttgcatttcttctggagcctgcaggagaatctgtttccttgtcttttccagcttctagaggccatctgcattccttggcttgtggctgttcctccaacttcaaagcccatcacctcagcctctgcttatgtcgtcacacctgcttttctgactttaactctactacctccctcttgtaaggatcattgtgattacattgggatcacccatctaatccaggctaatctctttatctcaagacctttcacgtaatcacatctgcaaagttttgccatctaaggtaacatattcacaggttctggggataaggatgtggacttctctgggagccattattcagtttatcatagatagctaagctaaactaggagtcagccatttaagtagatccctgtggatacttaggaattaggagatggagaaatgggggaagtatcccaggcagagtcttacaaataggaagatctggaggtgaggaagattatggcttttttagaggaatgaacttttgagtgtggttagaggatagatacgagagagagagatcagcaagggacaaatcatgaagggttttgtaaaccatattaaacaacttgaactcttaaagagcaaagggaagacatcaaagggtattcagtataaaagcaacaattatcaatttgtattttggaattgcatatagaagagccagattggaggcacaaaactatgatgctgatgaaccacggtggtgtcacctaattcacagcatgtctgaaacccaaatccattatttcccacaaaagccagcacattctccatcttccctattgttttcttctaggattcaattcttaacattatttttagcctctttctttctttggcttcttactctagtcagtcaccacaccttattggttcttgaaaattttttaaagacataatatatggttacatgaatacatccaaaataataaacaatatggaaataagtcccttttcatcccttctctgacccctaacaatccaactctcatcttcatatgcaacctgattcattatcaatatgtattatcctgtgccttttattatgcatttacatttattatgtacatgcatatatctactgcattgttttaaaagcatttgcattaaaaagcataattatcttgtctattttcagctcgcaatataacttagatattttccatgtcaatatatttattttaaatgcctcattttaaaattgaacatcggtattgctctcttttccagcttcgagagcttctaactctaatagattctaacagtttctaactttagactattacaaactttatcttataacttatttttcaaatctttctcttttgaaatttttattaaggctttctcttagccagcatttttaaaggtagaagtagtcttctctttaaaaatatcaaaatacacaatgccaagaaaataaacagtgatcttaaatattaggttggtgtaaaagtaattgcagtttttaccattaaaagtaatagcaaaaactgcaattacttttgcaccaacctaatacctttttccaaactgagagctctgtgaaaattcacagtggacattaaagactctgagaagttctgtagaaaaaaaaatatttaacttggtttaactctacatatccaaattttttgttgaactacatcacttgatatggtttggctgtgtccccaccctaatctcttgaattgtagctcccacaatccccacgtgttgtgggagggacctggtgggaggtaattgaatcatggaatcatggggacgggttttcccatactgttctggtgatagtgaataagtctcacgagatatgatggtttaataaagggcagttaccctgcactcgctcttttgcctgccaccatgtaagacgtgcctttgttcctcctttgccttccaccatgattgtgaggacccccaccccagccatatggaaatgtgagtccattaaagctctttttttttaaataaattacccagtttcaggtatttcttcatagcagtatgaaaatggactaatacagcactgttaacaattccatataatatctaataacatctcatgggatactgttgttccatgaagtcactgtgtggcctcaaatgtagtggttacaagcagggtccctgaaaccaaactattctgaattacttaccagttgaccttgggcaagttacttaacatctctgtgcctcagttttctcatctataaaataggaataatagcaatttgtttcattaggaagtcataaggattagttgaataagtgttagtggttattatttggagcattctgaggatactgctcttgaagtattggtatgaagttgatggcactgttagcctctctactgttatttgaagaatccatatcattgtgaaattaaaaaaaaaatcttgactatggcactcccatataatgtaccacacagaattgcccgtgtgagaagaaacagctctgttgcaaagaaattcctgtaattccatagcatctctctttgagtcattcagtttggggttcgttgtaaaagtactacttttttctctatccacagcatgacagttcttaccttttgacagtcttgtggactgctgtgcttgtggtaatccaatcacagctgctttgcaggatgactgctcctctatttgaaaggcatcctcaagggtattttgcgtatgtgatttagcttgtattctaagcatcctaaacatctctgtaagtgtgctgaaaattcatctaatttgtattgtcacatggtgacagtcaaacaggaaattaactttatttctattaatttcatcctaagagcactctcagaaacattctatatttaaagctgcatttcaagtacacagtaatgagatatattcagatataccctttcctttgattcaaatatcggcccctattatttttaggtgtgtgttactcaaaatagatgctttttaaacttatgtccctttgtgatgctatgagagtatttgactaccacatctttttgataatcagaagttaatgacttgtccaaagttatctatgctgaaaggcaatagaatgacatacaaagcatcttgccatctttctaaacagcttagcatagttcaacaaagttactggccacagagggaaaaatctacatctatatttaaagagagagatctgtttaagttaggaattgaacaataaaagaaaaatgaatttcaccctcctaatctgactagtgtttactagccccatttaactaaaagaatgaggatcaattactcatttttttctctacttgattaaaatgtgtaatgggtaagggattctccaggtgaggtatgaaatcgctgaaaagagacacacagtgatgatatatcctcaggtgaagtcattgcagtccagatgctggtcttcagtgcaaaggctgaaaaatttgatttggttagcacacagcaaacagatctgacatgggttcaaactaaaccaaatatggagaactccatagacaggaccagaacattcactcctgaagggagagctctatgggaagccaacttataatcaaaagtgtctggaaggaagtgagattgagcaagggtaattagctgtatgatttgagtgattcgtggcatgaaaatttctcagaatgaggctccatcacctagcatggaacatgcgctacagggaacaaacaactattttcattttcattccctttctctagttggagtctggatgggcactgacatcacctagctccttagatcttccttgtctatgccttggttcactgtctccttttcttcaccctgtatttctccggaaggactgcgttatcatcaactgcattctatcttactaaatttatagtcatagttcagtgctgccttctggagaaaacatcctgattttcttgatagagttttgcctacttctgatctccttagccaactgttactggaaaggggtcccgatccagatcccaagagtgggttcctggatctcacacaagaaggaattgggggtgagtccatagagtaaagtgaaaacaagtttattaagaaagtaaaggaataaaagaatggctactccataggccgagcagccccaagggctgttggttgtccatttttatgcttatttcttgattatatgctaaacaaggggtggattattcatgcctcccctttttagatcatacagggtaactttctaatgttgccatggcatctgtaaactgtcatggcactggtgggagtgtagcaatgaggatgaccagaggtcactcttgtcaccatcttggttttgcagcttcttcactgcagttttatcaacaaggtctttatgacctgtaccttgtgctgacctcctgtctcatcctgtgacttagaatacttaaccctctgggaatgcagcccagtaggtttcagcctcattttacccagctcctatttaagatggcattgctctggttcaaacacctctgacattttccccttcccttttacaagagaatccttaatcctaagggttgcagaggaatgaagatccatcttttgtaacttcttcatgctgaacaggggtgatgatattcctgcctaactattagggtctcttgtattcagagtagagaggagctcagttggaaagtgtcattacagtgagggccattcataactcttgagttctgacaaaaggtgatatctggaagattagtaagtgttcaatttaagaaaattttcagtaaacttattttgcattattacacaaagagtacaactgcaatatattccacaacagtaaagcaaaataagcaaaattatcccaagtaaactaaattagaaggctttccatgaactgggcaactgttggaaacaagctgatatggagtcactagccaattccaatatgtgcccagaattataatattgaaccatatttttacattacacagcccttttgtttcttttgagatgcagtcagacatcacgaattggttaacaggaataagcagggtcagtctaaattgcaggaaaaaaacgacaacaacaacaaaaaacaactgataagactagaatttaataacagaagtaccatacttctagaaacacaatttttctctgtctagttttccatttgtattaaagacaaatcatggtaagaccaatttgattgcaaaataatccttagtcttatatttaggctgattatttgtataaagtgcagcaagaataattatttttcacataggctttttaaattggctttgatggaattctgtcccataagaaatctcaaataagaccttttttttaaagccaagcccagccatgggtttatatcctcaaatacctatgaattaattcttcttcttttttttttttttttgagatggagtttcactcttgttgcccaagctggagtgcaatggcaaaatctcggctcactgcaacctctgcctcccaggttcaagtgattctcctgcctcagcttcctgagtagctggaattataggtgcctgcccccatgccttgctaattttttgtatttttagtagagatgggggtttcactatgttcgccaggctggtttcaaactcctgaccttgtgatctgcccacctcagcctcccaaagtgttgggattacaggcatgagccactgcgcccagccaattcttctcctcttgaggtcccaagataaccttcagctcctggacctattagaaagtgatattctttacttaccacaagtcagaaaccctgtacagggaatgtgtagacaagatataaggtcagttttcccaaggggcttttattggctctacaaatcaagtttgattccttaaaggaaaatgcatcattccagtcaaagccttggtaaaataatcagtttctccaattgtgtcctgttgcaaaagaaaacagattcttattgtgcttatgcaaataactatattgccataagttaagaatactcacaaataggttccaattctggagaagtcaggtagagagaaacaaatatgcctcaaattttgttcacaagagtacactttactcaactgttaaaagctataaatagctcaaaagaagagttttcttgtctctgaaaaacaaaacaaaggatcagcaacgttttaagcaaaaagtcaaaaagatcactttggtcttctattagctcaatccatgcagttaactcctgtcctgcttgatatttattaacatttcagcttttcatgagagtcctgaaagtttttttctttattctaatgtcataatccccaatgttatcagaaacctgcattcaagaacacctgttaaagtcctttagctgactataaaccaccttttaaataggattaaaataagacaacaactgttggtggatgacaaaatgtcttagggcagtcacagtcaaaagatatgattgacaaagcaatttgattacctcggtggcaatgttgacaatgtttcctgtatgatttttataccaaataagccaaacgtcatttttatattagtgtactactaatgttaaaccctatccttaataaaactttatagatacatctaaccaattttaatatttgaccataaggtaagattcttataccttttataactctttacaaatttatgttaaaaagtagattagtgctctaagaaaaacctgttgtgcttatattccaatgttcaattcatggaagaactgaataatacccctttaactttagccaatatgttcacacacagaatttcttttaaaagattagtttgtcacaagactttcccaactcactcaaaccttcaagcatatcctatctaacttcaaacaatcctttaaacttttaggcaaaaaaaagtccacattcctatgacttcttataatattttaccaaaaacgcatttcagtttctttacacaccttgcatgtaaaactgtttcttcagttgtctcaataacatattacaatgttagcttttagcaatttttacttttggtgaaaaacctggttagtaagcgattttaattatgtaccaggtgtggcacctaagacaacagataagatttgactttttccagcatagctagggggcatggctaacatcacatgtccccaggtcttatctagaatctaatgctctaaagtaggtaaattgaacaattttcaaaagtcaaacaagcagtttatgaccttaaagcatttagaaagcttaatatctgacctgtaaaatttagaccaaatgtctttattttatcaataatctttaaaactgtttttactttccaaagattacttaagtcgtgtactaaaaggcattacactttttacttttctgacaaaatatttgatttaagctcttatttttaaactaattaaagtttttaaaaatatctcacacacacacacaacacatataaatacacatacagaagaagattcagtagttgtaagacttttcatttgccagtttctaagtttgtctttaaggcatgcagtttctagggcttaacttgcaggcacagctggaaggcaaaacagatatacaaaattaaggatcccatttttatgccagatcctggatcccaaaaagagggaatcagcccatctccataggagtcttatctctcagcggtgggtggggacttttttttaaccttctaggttgccaacagcatacttctctgatctaaacatgcaaaaagccacatattcccccaataactgccattagccttccccaaaagtatatttcctacctagttattacacaacaaagttctctcataatactaagcaatttctgaccccccaaaagtgaaaaacgttggataatgcaatgcaaaacagaatagaaccttagatttttaaaggaatctatccatttccaattcctggagtttcatgaggaaaacaagtttttcccagaacccagtctgtggtgcctcctctgtttttcccaaggagtctcatgctgttagagcttgaatatccgctttaaataagctaaattttaaccatagcgctctttttaaaaagtccttttaaatctcttattaccgaaccaggccaaatggccaatattcctgtcttctgaactttaccaaaggtaatctcccaggtgctcaaagaaaggaaaaattccagaagggaagccggaagttgttcatcatgggtggggaagagaatctacaaatggcaaaagtcacacagatatcaaactagaaaagactcattccctaatcctggaattgaagctgggccaccgttgtaaaatggtgaagcctttgatgctgagctacagcattgggcagtttccattgcccttcccagaaggagcttagagcagccaattttgaacttgcaaaggcttttaacttctcaaggtaatttttagggctaaccatgaattccaaagttcctgctctccggaaggtggagaccaagagaaagtactgccacatagttataaggtcaagctctcaaggaaataaaataagatgagagggaaactttatccagttttttgtttttgttttttttagggacctgcagcaaagtttgtaactgaccagtttgctgggctggcttgaacagcgggcttacaggagtcctaagcctgtgttctatcttaaggtacccttctccattatagaacaacacagaaagacaaatttataacacaaagtacagattttactacagcttaagactagcctcacaattcctttttctgattaatcaaaacttgatagagttttggctacttctgatctccttagccacccatttacacaccagttacgataatattagtctgttggtccaggtacagatgaataaaaattcatttaggactaattttcttaattaaactctcacagggcaattttatttctcttatattctcacttgatctctcgtcttctctgtcaccttcatgtgctacccatggtgttacttccctcccttcatcctcctcacagggcagactcttggatttttagagagaagatttgtatttatagcccaaggcagggatagctataagcttcaggtcaagcatttttatagctaccaaccccttgaataatttctgaatatgattctataaaacattcacaaagtaaagtctaagtctgacatttcaaacacaaaatatgtcttcaatgaaccctgggtgtaatgataacatagtcattcactgagttttcaattttttttccatttcatcacaataccagatgagatacacaaggggttgaaaaaaacaactgtgttctttctctgcggagactgcagttgacagtgatgcaaaaaacaattaacctttctgaaaagccctgtttatcctaaccttattgtttcctgttcttttcaaacttggagcactctgggccttgttgcctctagagctttcaagatggagggaagacctggagtaaatccagagaatatgcactaacctgaacagcttcctaagagggggctggctctttgtctgtaggaagcagttcatttctgagtcatttcagcaaagttctggtttggtgtacactgtatagaacaaacacataggggtttgtggaagtcgaggaagctctggacaagatcctctcctttcagatctcctgagattttggggtcagcctgacctcatggttactgggaggccccaaagcagcctttaagtatgtatgtagttattcctgggagccttcctagaggcaagcataccaagtgtaacttgcaggtaaattgtagttcatagatcttggggaaagctaagggacagtatcatgggatgatgcccaatcacaaaaatcaggtagattacccaagaagtcatcattcttaagcagctttagagagagaatccaggtaacaaaccaatgaaagaatgtgctcaagagttaggatgagagtcagggcctggtgagcttcttatgttgacaaaggggtagttttaaaacatccattttacaatatacaatacatacctaaaataattcacaaacaaccatgtacatcatgagatataaacactcattttgagagcaaaacattacccaatgcattgaagccgctgtgttctcttctgtaattgaatacctgtgtccaccagaggtaatcatgatcttgaatttcctaatttgcctatatttatactatgaatgtaggcatttctaaattatatatatatttgcaagttatatacttcacatatatatgtatatatgtatatgctatcatttttcatgaattcttccgtaacgtaattttttttttaagagacagggtctcactcttttgcccaggctatagggcagtggtgaaatctcaaagctcactacagtcctaggctcaagtgattacctcctgccttagccttccaagtacctgggactacaggtatctgccaccatgcccagctaatttttaaattttttgtagagacatgggtctcactatgttgcccaggctagtctgaaactcctggcctcaagagatcctcccaccctggcctcccaaaatgttgggattacagatgtgagccaccacacccagcctgtaacttaattttttttattcagcagtgtttgtgagatctatttaggttgatgcatgtagcagaggttcgtatttgtctcaacagcagggctttttatgctgtgggcctagttttggaaaggaaggaagaaagaaggagggagccacttaaaggccctgatctgttatgggcagtccagattgtgcacttagtgtcccaaagtggtgacccaattcacccatcagtcagctgcaagagtggcgacgtgatgcagctggcggaggaagctaattataatggagaaaactgaatttgcatagagaaccaggaatcaactaaatccaaataacatttcctggttaaaaaaacactaaataaagatttaataaatgcatgtttactgttttaaaaaatagttttttgagttagatacaacaaaatttcaaaaattaggcagttttacaagtgctatgggaaaaatagcctaattaaatttttctctcctcttttttttctccaccgtcttagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggtagtattctttttattttttcagtcctccttgactgctttctgtttgtttgaagcaatttagatcagaaatgggccaagtgcaaccacaatggggacagatgtcagttaggaacttcatgagttctcatcagtagcccaaatatcggaaaactttggcatttcaccatttagccagacatgaaaatggaatttagctaataaagtggtattgatgagaacacttaatttgctaataaagtcataatttttagttaagaggaaggactacctaagtttgagtaccagctctggcaagtattagtcgtgtgactttgagcaagctactcaacttccctatgccttggtttcctcatcggtaaaacaaagataataacagtatccaccttatagggttgttgtaaagattaaggaagtttatacatatgtagtgcctgtcacctaagtgttcaataaatgttagctattatttatttgtaatgccattgtcagatcagtcttactggggatttgcctccagcacagctgcgagaagaaagggacctggagagtaaaaatttcccatcataccccagaaaccacttgaatttttaaaaataagtttcttgtgaagaaagttgaacgatgtgggcacagttgaatttcatatccactgtaggcagagctcatatttagctggtttccccggcatgacttcacctaatatttcagccagcatcaattctgattggttgcgtcgcctgctctaattggtcacatcattgttctgatcatttgcaaaatccactgtgattggctgctgcctgtaccgtctttgttttaaaatatatttggtcattacaccttaccccagaaaaaaaggagcagaaatagtgttccttcctcagtcactgccaactatgcaatgtgtaggttttgtgtcttgtatggctccccaagctacaatcagaagcttatgtttattttacctgaggagaaaacttatcatgtgattatattcacatgttgaaaaaatctttaatgtgcccaaagccactaggatctttagaaatggaaataatttaagtattcttgattgatgtttatttcacagttaagagcccagaagcttcatttccacttttccaagatattcaactaatcttgaagaaacaaaagtttcgatgaaaattattgcactttttctatgcatagaattcaggtggcaacaaaatgtagttaataatttcaaagaaatcatgaataatatttttgacattagtagtcaagtcatgaaaagtaaactaatttgtgtaatgccctgccaaaaaaaattatgttgtttatagggggtgacatattaactaggaattgatgacattccaaggggaatttaaaatcatttctgtcctggctaacacggtgaaaccccatctctactaaaaatacaaaaaattagccgggcgtggtggcgggtgcctgtagtcccagctactcaggaggctgaggcgggagaatggcatgaacccgggaggcggagcttgcagtgagccgagattgcgccactgcactccagcctgggcggcagagccagactccgtctcaaaaaaaaaaaaaaaatcatttctggccgggcgtggtggctcacgcctgtaatcccagcactttgggaggcagaggtgggcggatcaggaggtggggagattgagaccatcctagccaacatgatgaaaccccgtctctactaaaaatacaaaaattagcagggcgtggtggtgcacgcctgtagtcccagctactcgggaggctgaggcaggagaatcacttgaaccccagaggtggaggttgcagtaagccaagatcacgccactgcactcaagcctggtgacagagtgagactctgtctcaaaaaaaattatttctataggaataaacaatttaataaccagatgcccagagacaatgaagtacaatgaataggactttgttctgaatatttgtttctgtcattatcaataacttgtattaataattgttggctgggcgcagtggctcacgtctgtaatcccagcactttgggaggctgaggagggtggaccacctgaggtcaggagtttgagaccagcctggccaacatggcgaaaccccgtctctactaaaaatacaaaaattagcgggtcacagtggtgtgcgcctgtaatcccagctactcgggaggctgaggcaggagaatcgcttgaacccaggaggcggagcttgcagtgagccaagatcgtgccattgcactccagcctgggtgacagagccagactccatctcaaaaaataataataataacaattattattattatactctttcttcctttttctcattccatttttcttccctagtcttctttccttattccctataagtaaattcggttaaattgggtgtaatatacaacagagtatcaagaataaagtcattggtttcctggctcttcaaacttttttgagaatagcataagaaaggctgtttataaatccaagagatacttttacagaaaagagattttctaaagctacgtcttgtctccttgttccatctgcattaactgcattagatgtgttgtctcattttgttctgagttcttgtaatatgactcaggcttcaccactcttaacagcttggtgtattcagaagtcattccaaagtgggtggcatgatgttgagggtgtatgctgttgaatcacacagccagagttcaaatcttactttcggcatgaaatatctgtatcattttagacaagatgtttccatggataaatctagtttccccatttgacaacagaaataatatcagtgacatcataagattgttctaaggattaaataagctaatattacaaacagcttagagcaatgccagcatacagtaagcactcaaaaattgttggttataatcattagccctatagttggtttgtggtgcccttgatttgctagttgcagtagacactatcagtgctctactcagatcccctggagtccctctcacctcctagttttcatgcactttattctaaggacttgaagtacaaaattaccttcgggtgactggagtttcccataggattaaagagacacaagtgccaggtaaacttgagtgttaactgggtagcccaaagccaatggttgacgggtacagaaatccattgcctcaaggcagaacagactctgcaatgcaacttaagctccagagcttcccgtgggatgatgctgaggctggacttcacctaaaaatcacacccttgcttagcccctctccctgccttctcctgcctcccttactcccttatagatttctcttgagagcactacataagtcgcttgcacacaaatctacatagcagaattcgcttctagaaaacccagtctgagacactatgaagtttgtattaccaaagctattactatttagtaaagttcgtttcaggggaaatataataagtctgcaaggtgagcattaaaataaagaattttggttcatttgatttacaagctatgatcttcccaacaatttttatcacagtcattgtggtttacatactggtaaagaaaaaagtccaagctaaagaaagaagcccaagattaagcatcttggtcagataatataactttctgttggcttttctccctttatctcctctgaatagccattttattatgaatttaagtacaacctaaatcagttcagggtaccttaactttagcgcagtgggtctgcatggcaattaaattctgcaaacatttttctgatagatagatagatagatagatagatagatagatagatagatagataaaaatatttattataaagaattggctcatatgattatggaggctgagaagttcagacctaggagagatgatggtataatttgaatctgagtccaaaggctgagaaccgggagagctgatgcaataagttccaatccatgtctggcagtcagtagcaagggaaaactgatgtcccagcctgaagacagggagagaaaattcattcttactcagctttttactctattcagaccttcagcgggttagacgaggtacatccatattggggagggcaacctactttactcagtctactaattcaaatattaatctcatacagaaacaccctcacagaaacatccagaaataatgtttaacaaaatatctgggctcccagtggtccagttaagttgatacaaataattaactgtctcaggaatttatataaagctggctatagcccccgttcccacacttttgtgaattgtatagctcatcctgactctgtacccccgcttctgttgaactctcctctctccttgcatctcaccacttatggctattccttactcttttctttgccaggccagagaacttagtcctttttccttgatatcctccaaaaccatcaatacaagaaatttagatgggtaacagattttattacaacagtaaactttggtgctagctattacaatagttttcatcatgctatagaggtacaaatggatattttggggggagtctaaaggaagaagtaattaattacaagtaagatagaaactgaagcaatggtttcacagaaaaggtgaacgtttgtgcttgcctttgaaatgtgaaaaggacttttcacattggcaaatataggtcaactatgttttggctgtttaccatgagccacaaagccaccttcagactgtactaatcagtttcagaaggaaatggaaaccaaaattttttttagactgaaaaagattacaaagaataaacttatctgaaaagttagtaaagtggagtttgggaggcagtggatttattgttcgtttgtgtgtttatttgtttgaatagcttgtcctttgagataaaaatgtagaagacggagaaagcgtaaaaattgtactgaatcaatattttaggcctgacacccaaatgtgcttcacagtccacatacccactaaagtgtggcattgattaaggtgggactggtctttggggactcgtaaaggtgctccatacccagaaggcacatggcaagcctgataattacctccaggcataaatcatcagctggggaataggcatctgtctactaccattgcattttaagttcattcaagaggctgaaatatatttgtatacattcttctccttcagactaagcaggaaggagtggtaggagatagcgagacacaggttttcactgttagagggtaagaatatttttaaggttctctatggagagcaagtcactcaaatttattgacggctttactgcaatgaagaaaaagcagaaatgttgcaaataaaattgagctatcaacaattattgcaaatggataaaaatactgacagtttcgaagcacaaaatggaaatcattgttgattattttgattttgtaccttagattgcttttcatttacttcaaaagaactcagactaacatgtacgtgggtcataatatctactccaaaaaaatctcattaacaaatttttactctacttgatctctcacacctaaaaacaaatactgttaaatatctactttgtggtattgacttgtacttaaaaatcctcaacttattagtgaatattcatttcagcagtatattgtgagctttattctcactaagggtacatcatttccatttgaccaccatacatgaaaacatatctgcacatgttttctttggcacctaatcttgggcttgcctcagtggtaaactctattggttgccttacaacataacatttctcctttctttctatccaaatcaaagttttattcagctctagcagtgaattttttaaacaaattttttctcaaaaaaaattttttttattttttaaaaaatgttttaggccaggcgtggtggctcacgcctgtaatcccagcactttgggagaccaaggcgggcagatcatgaggtcaggagatcgagaccatcctggctaacacggtaaaaccccatccctactaaaaatacaaaaaattacccgggcgtggtggcatgcgcctgtagtcccagctactgggaggctgaggcaggagaatcgcttgaacctgggaggtggaggttgcagtgagccgaggtcgcaccactgcactccaacctgggcgacagagcgagactccatctcaaaaaaaaaaaaaagttttaaatatttgtgggtacatagtaggtgtatatatttatgggatacatgagatgttttgatacaggcatgccatgtgaaacaaacacatcatggagaatggggtatccatctcctcaagtgtttatcccttgagttacaaataatccaaataaattctttactttaaaatatattattaagttattattgactatagtcaccacactgtgctatcaaatagtaggtcttattcatactttctatttttttaactcattaaccatcccccccccgacccgagccccacactaccctttccagcctctggcaaccatccttctactatctatgtccaggagttcaattgatttgatttttaaatcccacaaataagtgagaacatgcgaagtttgtctttctgtaccaggcttatttcacttaacatagtgatctccagaccatccatgttgttgcaaatgactggattacactcttttttatggctgaatagtacaccattgtgtatatgtaccacgttttgtttatccattcatctgttgatggctgcttccaaatcttggctattgtgaacagtgctgcaacaagcataggagtgcagatatctcttcaatatactggcttcctttttttgggtatatacctaggagtgggattgctggatcatatggtagatcaatttgtagtttcttgaggaactgccaaactgttctctatagtggttgtactaatttacattttcaccaacagtgtatgaaagttccttttcctctgcatcctcgccagcaaatgtattttggtttcttgtgtaaagctggctcagttgaaatgcgccactaaataagccagaacttaatatctccaagagaccacagaccccagcctagtaactcccattcaccttatggttttctcttaatgtgactgattttgtcatttcagtgctaggagaagagaaggaaggagaaacaggaggggagcgtgcattcaaattgcttatttggaatcctgcagataagttcaatatttggttcaaatggatttgaagtgatttcaagaattatacattcagcctggaagtcagggagtctaagcgccaagcaataatacccttttaatacactataaatgtttgatcatttgtttgtttttccaaatcttatcactctaccactaagagcaaaattagtttgaccttctcaaaagcctaaagactcattgtccccataaaacaccaggagaactgttggactggacttctagtttggtaaacactttggtttaatcctaatagaattgccacaaagcttcttaacggattaacagaaactcccagcatgaacatactggctccctaatggaactcaaatgcttaatgagtcacagaaaaatgaacaaaaatattcagatctgccttaaaccttggacgttttcctagcaaagaccttaccaatttcaatatataattacatttagggaaactaactttaattttgattctagagcatttttctccgaggaagcgttacttgtaaggtgcaccataggcacagggccacaaatacctgatattcagagacatgttaaacattggattgtccaaataaataaacttgccagatcatttttaatatttttttacattttattttattgacacatagtagatgtacatattttcagggtacatgttataatttcatacatttatataatttgtaaagatcaaatcagtgtagttgtgatatccatcaccttaagtatttatcttttccttatgctagaaacattctaattattctcttctagctatttcagaccattttcttgggggtttgaaataatagatcaccatagtcataagtaagattgttacctgagactatatctattatctgtatctacatatgtctctatatagagatctatattatttcaaattattaacgtgtttatattatattcatataagatatatattatttcaaatacctagactatatatagaaatatatatagagataggttttctctctacatatataagtggagagagtctatataaagagagactcagtataggctggggattggtttcagggcccgggtgtataccaaaagccacacatactcaaggctaaagttggccttgtggaacttgtgtatagggagagttggcccactgtaaatgtgggtttcatattccacaaatactgtgttttcaatcttcatttggttgcaaatgcagaactcaaggttatggagatccaactttgtttattttttaaaaatccacatatagatgaacctgggcagttcaaacccatgttgttcaaggatcctctgtatattttttactcttccccatattcccattttactaccctttcccttccttgtgtattgtctctagccagaattggtatagaggtcatgtctctaggcagcaggggttagttggcactcacatcccaagaaactaccattccctttcaatgcaaattgcagaaacagaacaataaagcccatgtaatccagaacctggctgaatgttggggctggaagggggagtaaagaagacccatcccctcaaaggtaagtcagctcataagggaatatctaatatcaactatatccttggagaaataggtattttattcctaagaaaatgatataagtgaaaacttcactaataaaaatgtcaccactaatattttagatttcaggcaagtgaccattttatatcaacagtaatcttataagaatgttcctatgttaatagaagttatggtttaaccaatttaaatttataataagattaggctaacatgcatttcataatttttataattgttcttttattgcagagtaattaagcataatgaaaatatttaatgcaaagaaattaataaaattcttacacagcaagcaattttttaaagtttttaatctcagtattgtgctaggatctataaagggcatcaatgtctgcaacttttaaaataccataaacctcaatccacttaaacatttaatatcttctgatacatattttcattatagaatcaatgggcttattacagaaaattacataaccatataatatgaacattaaagtctcacatagaattccactttccagaggtgaatagtctccatttgtgttgaatttccttcctgtcacttttatgtgtatatatatacacatatatatatgcaattttcatatagttggaaattgcatgaaatttacatatacatactgtataaaatatcataaacctcaatctgcttaaacatttaatattgtctggtacatattttcattaatagaatcaatgggcttattatagaaaattagataaccatataatatgaacattaaagtctcacatagaattccacttcccagaggtaaatagtctccatttgtgttgaatttccctcctgtaacttttatgtatgtatgtatgtatatatatatatatatatatatatatatacatatatatatacatattttcatatagctggaaattgcatgaaatttacatatacatactatatatgtaaattttattctttatttttgctttgcattatttcatgaacatttttcatgtcattaaaaattatttgtaaacatttttattggctggataagatttcataacataagatttttccatataacatgaatgtgcaacgtgtttcttaactatttattcttatttccatgaacattctcattcttaaatcctcttatattgtgattcatattttgaataatatttccttaattttaaaaaccggcaatctgagaaaattgattcaattaagaccatgcatcttgtgaatcagattgtttattgtttatcacaaatctcaccttcctttcgtagaatctgaaagtttgtaattaactgccagtgatggttttcagtgaagcatttaaggaaagaacaacacataaaggaaacatttatattcatattcaacaaatttcaaagaaatggtgacaacatttcttgtatcatgtactgatactgacaactagggaaactgctcgaaatgtgttttgcaataacctttatctgtgaaaatgtgaatccccataagtatcacctaaaaaggtaaaatgggaaaaagtaagtactgataactgcctttgctgaacatataaccccttccccaccacatttaaaataatttagtttgcacaaattcaatttagagtcattctagaaataaacttcagttatacatttataaaaactaaaatggaaaccctctagtatgtgtccatattcagcagcagaattggttttaaagaatttttcatgagcaacatgttctctctaaagtatcagtttttttgtatgaatgcccaattttcttccatcaagtcaattctatcattgcattgtgataccaaatattttaagaagcccagcattttatcttggttgttttttaaagaaatgcagctttcctacttcttgctgtactgattctatctccatctctgtttttttctgagtaatttatcatattgataacaagactttctgatgtttttaatactcgagcaaggtattctttgggtttcagattagcaaaacacattcttgtttcttaatgggccaggaaattgagacaatagttattttaagatagttccatgtgggagacttggtttgctaattacgtatgagataaatttctgctatgataagactatagtgaataaacagcaaggtatcaaattgcagtgattcctaactcctttagagttgtaacgagctgtttttgtcatattatttataagatccctgtcttaggttggattcccccagaggtagaccttgaactcatgatttgtgtgcaagtgatttattaaagagaaaccataaactactagtagggaaagcaacacaggaaaggagaagaatctaagcaagggtgagaagtcaggcaaaatttggcagaggtcaccatcatcatgactttacagagacagataatgtttgctgttttgtctccattgtcctttttaaaaagaattcagaatgaatgcttgagtcattgtccctttgcatatatgagcacatttaatgtttctggaaaatctgtaataagtcattgattctcttaggttataagggattggttaagttcttcctcgtatttctgtggttttaattattttccctaaaactgttacttttcagcattattgctccgttgttttcagtattttttggatttgggttttttgttttgttttgttttgttttttgtcaattgcctgtcagttgacatggttttgtgagattttccggtatattcctatgagccaagctttttaatatcaggaagtttcttctgcagatatgaagacttcacaatgccctctttccttgagactatttgtaaacatgaaattggcacaagtcacaagacttctttatctaaacaagtgttcttttactccttcttcttgttactttctcttaagcagctttttatccaggcataactttttcccagttctcagagagttgtgattctttttaatagcctttgatttgaaaactaatcaaaagttatacaaaatgtattaagatagagtcatgcttgttgaagaatgactctcttggggaatatttgtcatgagagactttgtgataagatccagtttgggcagatgccatatgttgaaagaagctgggcgggcggaagaaaccctccatgtttactgaggcttaactttgagtgtgctcagcatggctttgcacagctaggaaagaaacaacagtcatgaataaatacggagtcctttctgagcaaaaatattttaatatattgagagccagtgggaggatactggtgtgtgggaagagtgcagattttggaatgtaaaattcagggtctgaatcctgacctccttatttaatagccctgtgacccacaagttacctctcggagattccactttcctgtctataaaatgggaatcataatgtatttttcatgggttgttgtcaaagcaatggtatgacatgtgtattagttcgttttcatgctgctgataaagacatacccaagactgggcaatttacaaaagaaaaaggtttaatggactcacagttccacatggctggggaggcctcacaatcaaggcagaaggtgagaggcacgtctcacatggtggcagacaggagaagagaacttgtgcagggaaaattccctttataaaagcatcagatctcatgagacttattcactatcatgagaatagcatgggaaagacccacccaaatgattcaattatttcccaccaggtccctcccacaacacatgggaattatgggaactacaattcaagatgaaacttgggtggggacagagccaaaccatatcattctgcctcttgcccttcccaaatctcatgtcctcacatttcaaaaccaatcatgccttcccaacagtctcccaaagtcttaactcatttcagcattaactcaaaagtctgcagtccaaagtctcatctgagacaaggcaagtccctcccatctatgagcctgtaaaatcaaaagcaagttagttacttcctagatacaatggggtacaggcattaggtaaatacagccattccaaatgggagagattggccaaaatgaaggggttataagccccatgcaagtctgaaatccaggggggcagtcaaatcttaaagctccaaaatgatctcctttcactccatgtctcacatccaggtcacgcacgctgatgcaagaggtgggttcccatggtcttgggcagctccacccttgtagttttgcagggtacagcctccctcctggctgctttcacgggctgatgttgagtgtctgtggctttcctaggcacacagtgtaagctgtcagtagatctactgttctgcggtctggaggacagtggccctcttctcacagcttcactaggtggtgccccagtagggactctgtgtggggctccatccccacatttcccttccatactgccctagttgaggttctccatgagggccctgcccctccagcaaacttttgcctaggcatccaggcatttcagtacatcctctgaaatctatgcaaaggttcccaaaccccaattcttgacttctgtgcacttgcaggttcaataccacatagaagctgcaaaggcttggggcttgcaccctctgaagccgtggtctgagctctacattgccccctttcagccacagctggagcagctgagatgcagggcaccaagtccctaggctgcacacagcatggagaccctgggccctgcccatgaaacctttttttgttccaggcctgtgataagaggggttgccgcaaaggtctctgacatgccttggagacatttcctgcattgccttggtgattacatttggctcctcattacttatgcaaatttatgcagccggcatgaatttctcctcagaaaatgggattttcttttctatcgcatcgtcaggcttttatgctttgtttcccttttaaaactgaatgcttttaacagcacccaagtcacctcttgaatgctttgctgcttagaaatttcttcccccagatactgtaaatcatctctctcaagttcaaaattccacacatctctagggcaggggaaaaatgccaccagtctctttgctaaaacataacaagaggccaggcacggtggctcatgcctgtaatcccagcattttgggaggctgaggcttgcagatcacaaggtcaggagatcgagaccatcctggctaacatggtgaaaccccctctctactaaaaatacaaaaaattagccaggcgtggtggtgggcacctgtagtcccagctacttgggaggctgaggcaggagaatggcatgaacccgggaggtggagcttgcagtgagctgagatcacgccactgcactccagcctgggcgacagagtgcaactccatctcaaaaacaaaaaaaaaataacaagagtcacctttgctccagttcccaacaagttcctcatctccatccgaggccacctcagcttggatttcattgttcatatcattatcattttggtcaaggccattcaacaggtctctagggagttccaaactttcccacattttcctgtcttcttctgagccctccaaactcttccgacctctgcctgttccccagtttcaaagttgcttccacatttttgggtatcttttcagcagtgtcctattctactggcaccactttactttattagtctgttttcatgctgctgataaagacatacccgagactgggcaatttacaaaaaaaaaaaaaaaagaggtttagtggactcacagttcctcttggatggggaggcctcacagtcatggcggaaggtgaaaggcacatgtcacatggtagcagagaacagaagagaaattgtgcagggaaattcccctttataaaaccatcagatctcataagatctcactatcatgagaatggcacaggaaagacccaccaaatgattatctcccaccaggtctctcccacaacacctgggaattatgggagctacaattcaagatgagatttgggtggggatgcagccaaaccatatcaacatgtaaagtaaagtgcctgttattatgtggctaagtgttgtgaaatttaggttttaatgataggcactgcatgtggaagctacagcacaaatgaaagcataattttttttatattcagagtacagaaagaaggtctggtcagccttgaattttcctcaggcaaatatgaaataccacagtgttgatggcattgtctctgaatcttacaaaagatgggagtgcaaggagctgtgcaggcatcagaatcaggctgctgtgacattattctgcccgcatatattattttagtgatttttgtgtcattgttgacaatagactttgtcagtcactgtggccttgctctcttaatggaatatgaaacactagttctagagaagtacttagcttgcaggcattacatcagaggctgaagcaaaacctgacagcaacatctctgcaagtggaagaaagaataaaaactaatatttcctgagttcttattgtatttttttgggaaataggtttggctgcgggtgacagagacacattataatcatgacttaaaatgggaacatattcctgtctaacgtaaaagtctgggttgactggtggcttttgtggtattgttatgggggctgcattaaagcaggggtctggactccctatcttttgttgctccaccatgttgagagtttagctcttgatccaggatggttcattcctatgttctcatcccagcttcaggaaaaagagaagaggtcaagggaagaggattctccctcttccattaaaggcatgacctaaaggtatatcgtttctgattacactccattggccagcatttagtatcatgacaaaacctaactgcaagaaatactgagaaatctagtttttattctgagtggccatgagtatagctagatgttccactaataaagaagaaagggagaacagatattgggaaacacataccagaattgtctattccataattattatgtgtcaagctgtgctaaacacttacaaacattgtcttacttaatgctcataacaacactgtaatgctgtttttacagaagtattttgagacacaaagaggttaagtctccttaagtcttgagacagagagacgttaaataattgtcttaaggtctcagaggaaataagtggcatagccagaacttgaacccaggcactctgactttagaaccctgtgctctgggccactgtgtaatccttgcttgctcattatctcccttaggccttgatgtgctctactagatgagattgtttaaaagcatcaaggaattaaagatactttataaactgtttattcatggcttcctcttcaaggcagctaattgcttccattctaaaattcctatcttatttggtgtaaaatggtgttcagtacaatttggtccagacaagataacacaagaaaaataatgccacacaaatgtgacaagaattttaatgaaagcaattcctgatttgaaagaaatgtgtctatgtgatgataaagcaaaaagtctttttaatacatggaacatttttgatgatgggatggaaaaaaacattcaatatatcactagaatacagaaatgaaaagattgtatcattcaacaaccatcaagatagttaatcttttcagtctttacaatttcaactacatataggtcagcaatttatatgttaatataaatgtatctatagagcaacaaggaaaattaaagaatgtgaagctgttgtagatttggtggtcagagaaaaccttccctgggcaagcagcagtaaaactaaaattaaaaaaaaaataagcgggagccagccagattaagaattaagttgtatgtttatcagtcaatataggttaagtgatgctgcagtaacagctccaaactcttagtggcttaaaacaacaaagatttctcactcatgccacatgttcataacaggatgtctggggactctacttcatggcattttcagaccaggatccagacttgcagagcagacactatttggaacattgtcattctctatggaaagaaaagggtgtgtggtgaaccctgcccttgattttaaagcttttagctgggattacttaccacgtttcattggccagtgtgagtcacatgatgacatctaatgccaacagggcagaaaggtgcaatcccaacttgctttcagaagtaaggagaatgggaagtatttagtgaacagataaatgactactgttttgggtgatggaatgtggagggaaggcattcccagctgaagaaatagcatgttcaaaggccctgaagtgggaaagaacttggtatatttatgaaactttaagaagaattatgttgctgaatcctatctcctatctgtagacaggagatgaccagagggaagagggagcagattaggcagatctttacaggctatgggaaagaggtataaatttcattaaaaatataaaggaaaactactggttggttttaagcagaggaaccacatgatgtaagaaatattttaaaagagtattgactaatgatattgattattccatggagagtagattggaagggaattgaaagtagggacacctaataggcaccttttcaaaattctaagtgagattgcatggtggttccagtttaatgcagtcttatttgaggcaaatattccatctattttagacattttttaaattattaattattatccatttcaatctccttcccatatgcctcaaattcatacagcacttcaagccactgcagtgagccacagggaaggaataaaggttttcttttcctcttcttttacttctttttctcttttctcttcccctactaaggatctgtgcctgcttatgttgaaggaaaggaaagagaaaagttatgcttcattgcttgaaatatttggtgatgggacaaagaggtctcctttctgtcgtcattaccatttctccatatgaaactgataacagaaggctgtgatatcttctcactctgtttaatccacatgaatgttcaaagagctgatattctgcctccaggatgtttgtagggtaggagacgcacaatcccaagcagggttccttctgttctggctccaaggggaagtgaggctgagaggagaaatgatggataatgagaaagtgatgtactcattagaactgaataatggtttcaacagtgtttaaattcatgattttggatataatataatttctagagataacaacttccagggtttcttcatgagagtgaatggtgcacatggacaggaaggtcaaagaagatgaccaggtcaaagaactgaaagcccagggagttggatgtgttatgcccaggaatgatgtactctgtaagaaatgaagccaagtcaagggtatatccatttcctgtggctgctgtaacaaattaccacaaacttggtggggacttaaaagtgcttagtatggctgcctgttgcaacacatgagtcatggtgtgtcatttgtctccttaactaacataaagggtaatggtaattcttagtagatgttttgtttagactcatttttttcctcaataccagaatgcctagcacagtgtaggcgtactataagtgcttgttggatgaatgagtgagacatgaagtcaaagattttaaaaactttgctctacagtttgaaaattctctttttatgaatctatcatcaggctgagaaataaatgacctggttcctgattccatctgtactgcttattatttttaacatgagtcttacaatacctcacaagctagtttgaaagatcaaaagaaataataaatagctttaaatattcaactgctttattacctagcatgaaattggatcctgagcagtatatacaataaactaaggcctttgttcctgcctttgggaagatgctagtctagatgggcatgacaaagtttaacaccacaaatgtaaaaagatatggtataaaatgtgtgggatgattctcaatttttttttcctagaacatagacattctgtgttgaagaagagattggctcagtagcaccaagcaatgacatgtctgtgaagcatttaagtgagaaggaacctgtcttctggagcagtgttttacaaatttggcaatatattggaataaacagtgaagcttttaaaaatcccgttacctaggccacatccaaagctaattatgttagaatctgtggaagtgagatttgcgaatcagtatttttaaaatctttccaaagtgattccaatatatagccaaatttgagactgaatctccaaagctgtgcttctccaactcaaatcacctgaaaattttgttaaaatgtaggttctgatccaacagggtctaaggcagtgcctgagattctgcattcctaaaacgttcccaggtgatgctgatactgctggaacaaggaccacacttggaacagcaattttctaaaggataaatatatcacatgtcaggtagtaaaagaagggacatggaacctatgtaccaagcagcatgctgggaactttacatttatcatctcatttaatctttaaaacaatcatgaaggaatattattactctcattttagaaatgaagagactggggttgagtgggtaaatcattgcctgaggctggacagcttattcatgatggaacctggatttaaacataggcatgtctaacagcaaagcccataggctaatagaaattgttggaaactttcaaatgctaagcagaagcttttcgatgtgaaatggtaggcagtctacagccataccactctgaaagcacctgatctcatctgaaatggtaggcaatgtctttattacttttcttaagtgcatggagattgtgcctacaatgatgctgagtttgatttcacactcctgcctcaagtagtatatataggcaggtaaagaaccaggtactgtgtatgcctgtaacctggggccatgctctctagtgttatggtatcaaagatatcctagagaagttacagtagaatgagaataaatactaatagcaaaataatagtgctggaagagaatgtcaaaattcaaaagtaaaacacaaacattttatttttcagttactgatatcaaaggattgttgcctctggagggagaaattgtatttcctgaaaatatttggttctaactccttgattcaaatgtccttccaaatgaaaatatctcttgattaaagagatgggaattgaaactagcgacaccaaataggcaccttttcaaaattctaagtgagattgcatggtggtccccagtttaaagcagccttatttgaggcaaatattctatctattttagacattgttttagacattgtagatatctctgctcctgtttgtttttttaagtgattttttttcccctcttctttcaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgtgagtttcttgatttttcatggaaagtggagattgatgactgaagggattggagtggggaaggcaaaagagaaaaagagtattttaagtttaaggatagagagtgcaggtgaaattacagcccaatcacaggcttagcaatgccttggcagggctctggggtgtgtgtgtgtgtgtgtgtgtgtatgtgagagagagagagagagagagagagagagagagatacagaaagaatatttttttaaaaattgcaaagcattgtaaaattggaagcctcactgaaccatatctctttctttttaatcattattaatattattattttagggacagggtctcactctcaccctggctggagtgtagtggctgttatcatggctcactgaagcctcgacctcctgggctcaagtgatccactcatctcagcctccagaatagctgagactacaggcatgcaccactacacacagctaattgaatggcagggtcttgctgtgttgtccaggctggtcttgcactcctggactcaagggatcctccagccttggcctcccaaagtgctaggattacaggcatgagccactgcacccggccactctttctgtatttcaaaacttcccctgagcatccttgtctcagggcccctcttggcttcacgtggctcctcagagggcatagataatttccctgagacattcttagacatttgaggtgactggcaatatggttctcacatgttcagcctgctctgcacatcagctgacaagcaaagctggagtacttcccgaatttcctccaaaccgaatttcctccaaattctttctcattccttgagaaagaatgaagggagagaaccttcccatttgcctctctgtttagcctgtgggagtgcagtaagcacaaatttcactttgccaacttgggtgaaagccaagagtcattgttttctcagttcagttaaaccagtcttagtctgattcagtctctactgctcccctccttttgagaaatttcccctgaatccactggtatgttttctccctcccagtgtctgtctcctctgctctgggaggtgcctcataatctcatctcaaggcagctgagtgttcatctacctttcctgtgaatccaattcattggtttttgttttgttttttgcctagttaactcatcctgttacagtagtttaggggctgtcttgggaggaaaagtaaatagtgagatagtagaagtgatctttcattttcatcttctctaaatgaggactaccgttctgttgaagacgcctatattcagtgcttacatttttagccaatgttatgttccctgtactgtttcacaaaagtgatcctgaatagagcaattcaaactatgttttaatactggattgagataagtagggttatttttgtgaatacatagcaggtatatatatttatggggtacatgagatattttgatacaggcttgcaatatgtaataattacatcagggtaaatggagtatctattacctcaagaatttatcctttgtgttacaaacaatccacctatactcttttagttatttttaaatgtaaaattaaattattattgactatagtcacccagttatgctatcaagtactagatcttatttattctgtctaactatttttatacctgttagccatctccacttcccttgacccccactacccttcccagcctctggtaaccatccttccactctctatgtccatgagttaaattgttttaatttttagctcccacaaataagtaagaacatgtaaagtttgtctttctgtgcctagcttatttcacttaatataatggcctctattttcatccacgttgttgcaaatgagtggatctcattcctttttatagctgaatagtactccactgtgtatatgtaccacattttcttcatccatttatctgttgatgagcacttaggttgcttccaaatcttggctattgtgaatagtgctgcagtaaacatgggagtgcagatatctcttcaatatactgatttcttttcttttgggtatatacctaggagtgggattgttagatcatatggtagctccatttttagtagtttaaggaacctccaaaccgttctcctagttgtactaatttacattttcaccaacagtgtgtgagagttccttttcctccacattctcaccagcatttgttattgcctgtcttttggataaaagccattctaactggagtgagataatagctcattgtagttttgtcatgcatttatctgatgatcaatgttgttgaacaccttttcatatgcgtgtttgccatttgtatgtcttcttttgagaaatgtctgttcagttcatttgcccattttaatcagatgattagatttcttcctaatcagattattagattttttgtagagttgttcaagctccttatatattctgattattaatcccttgtcagatgggtactttgcaaatattttctcccattctgcaagttgtctcttcactttgttgactgtatcctttgctgtgcagaagctttttaacttgatatgatcctatttgttcatgtttgctttgattgcctgtgcttgtggggtatttctcaaaaagtgcttgcccagaccaatgtcctagagatttttctgcgaagttttcttatagtagtttcatagtttgaggtcttagatttaagtatttaatccactctgatttgatttttgtatgtggtgagagatatgggtctagtttcattctatgcatgtggatatccagttttcccagcaccacttgttgaagagactctcctttccccaatgtatgattctggcacctttgtggaaaatgagctcactgtagatgtatgtatatgtttcttcattttttattcggttccatcggtctttgaatctgtttttatactagtaccatgctgatttgtgtatgctatacagcataaaaacatagaaattatagttctgtggtataatttgaaatcaggtaacgtgattcctctagttttgtttttgctcaggacagctttggctattctgggtcttttgtggttccatgtaaattttaagattgttttttgcagttctgtgaaaaatgtaattggtatcttaacagagaatgcattgaatctgtatattgctttagataaacagttttaaagaaacgaatcttttaagttcttttattacttactttggatacgttattttgatttacttaagcaattattctcaattctttatctcacataaataaatttttcttagtcctttctgtcatcagcaaacttccttctccagatctgggaggatgaacagtgatgaaataaacaatatatggatttcaacataatcttttactgatttgaaggagctctttatatattctacgtacaagctatgttggttacctatattgcagatatcctctctcacctcctgacttggctttccattgtcttaatggtatcattttatgaacagaaatctctactttttagtagttccatttgttaattttttcctggattactagagggatttttttctgaatcctgttgaagaaaactttccctaacaccaaaatcatgaaaatattctcctatgtgatgttttataattgttattgtcttaccttttatctttaaacttataatccacctgaaacttattttgtgtgcatactgtgaattagaaactgatttttatattttaatgtgggaattatgcagtggctgatttgagtatcctagataactctattcaatgatgtttgttaattgcattgtccaagtcttccatatacttagtgatttttaatctgcatatccaatcagatatcgagaaaggtatgctaaactctctcaataataattgtggatttcttatttatccttttagttttgattatatttgctttatatatttagatttactacagagttaccctttccactgctctttattctttgctatatctctatgcttccatcagaataatttttcttcttcctaaagggtaccctttagtatttcctttagtgtggctttgctggtggtgaatactctcaatttttttcttagcatggctttatttcactcttaattttcaaatgtgtttgcactgcttattgaatcctaggttggatgttattaactttcagtaatttgaagatcctattggcttctgatttccagtgtttttattaggaaatcagctatcagtatattattgttcctttgaaggtaatatttttaaaacgtttttaatattttcccctttttgtcgtgttttcaacagttactataacaaacctatgtctgattttctttgtatttatctattttgatgttcctagaacatcttgaacctgtacattaatatcttttgtcatatttgaaaacttctcagggaatatctctttagatatttcttttcccccattatctgtctcctctatgccaggtagtcaagatatgcatcttagtaatattcagcatcttttagatatctttatgctcccttctgtatttgttatccatttacatctctaaactcagtttgtatattttgtctgacctatatttcagttcatgaatcctgcctttgtgtctaatttgctattaaacacatccatttaattcttaacttcagttactgtgtttttcaggtttagaattttcattttgcctctgttatgttttctaaccgtctgctgacctactcatttttttcttgtaatttcttgaagtaattatttggaattatgttaaaatgtataaattatagatctgttatctgagtcccctacgggactacttctattgtttattgtttcttgtggttttggtcatgtctttcttcccgtaaacctagtggttttttattgatggccaaaatatatgaagaaatggtaggacttaatgagactctgtataatatgcctctattgagaatgtacatttttcttctgaaagggaattaggataaggctcttgcatatttaagattaccttaatcaagtcaaggattgaactaatttcaaaattgggaccttggtccccatgagggctgatctgtttctggatcacataaactcatagggaatactccttcagagactcataacatgcctattagataagagaggcaattggttttatattttatggatagtgtaaacaagaacgctaagagttagatgtgtgttagtagagttgggatgagtttaaaagttttggggttttttgtttgtttgtttgtttgcttgttttttcacacagctcttttcccaccagattctgccaagatgagattttccattttagagcaatgaagaagaaaattgaattttaactaatgactgatttgctagtcctcaactatggagtctgaggatttatgggggaatttctcaataactatttctctaaatttataaaatactatttgatcgttagtatttatttttgtcatttatattccatgtttgttcaccctcttctttacacccaaggccctcactcacttagacaacagtaaccagggactgtgactcaaaaactcttcaatcaattataagtcatcttaagcttctgtaccgggagaagaattttatctttaacttctaaatatcactatctaaatatatctatctaaatatcattacaaggtaattactgaggtatacttttcaatacaagatccaaggagattgtgtattcacacattttgccatcaactaatctgctagttagtacggatgataactagaggcctaagtcactcataccgctctcctacattttatcagattaactttaggttattttaatgagaaattaacttttaatataagtcagtggaattcggagattgttttagaagctagcctacccaaattaatataaccctttcctgtggtttttcccttaatacttacatgctctatattttacttatttatcttattatttttctttctccactagaatgtaagggcaggagtttttatctgtactgttcactgatgtagttctagtgcctaaaataatgtctatagtaggtactcaatgaatacttgttaaatgaacagatagatgaatggataaacaaacaaatgaacaattgaatggatgaataaatggttggcctctacttaaagtatatcaggcttaagcaagtggaacaaatgtagaacaattgtggttttcttctgtcaggagcatgggattaaaaagaaatgagccatgccaaatgcatttgccctctgaacaaagtaaattcctaactgtcacgtaaagatgtaacataagttgttgtcagagggtataagaataaataataacaaatcaaaacttccgtgtcttccttgggacatgttaatgcattgatacagaacttctgaatcaattgcactaattttattggtgtaacaataatttaatagacccaaatatccacctatataattaatccattcattaacccatccatctatctttcccacacatttattgataacctgttaagtatactagggactaaggatacaaagttgaataaaaaatggtctatcttcaatggttacacagtataaggaggaagatgagtttattattttattcataaatttctgtcttgatgcgttaaaatgtcttaaggaagaaacagctctttcaatgtgtgattctaacccttctatgacaacaacttgtcttttagttatatccttctgtgacagctagaaatttacatgatgagtatttaatttgatatatcaaaattacttctcatttttaaagctgaaaatcagagtacattacttctccaacattgcaactgttagtctgtgtgatattagagacttaaactatatctcagtattggaagtatcttgtttgctattcatggagtggttttcaaaacggaagcataaataatattttattggcagcaaacactctttgtttattgtgagagaatattgcagccccactgagctgtctctatatttaatagaccataaaattgaaattcccaccctgacctctaagagatgagatgagtcagaaggtgactcactctctaatcagttggaagtaaatgacctttattgtcatttactttggattgggtaaaagtaaagagcttttattgctttagcactgaaacgattacagcaaggactgacagaggaaggttacctgttataatgggctgagcaggccctgacattttctccaatcccttctgattccaacaagttggctattgtaagcctagtttttaaactctataaaaaacatgataaaagggaccttgacacagccagttaattcatttttctatcttaataatacctacaaaattccacattgttatgttagctgaggcagttgcagtccaacacaaagacagtcataatgatcattttttctaattagtacccaattgaattcagaaggccccaaagataaaagcaacatgagttggaacaaaacatgaaatattttttctttttttcttttttttttgagatggagtcttgctctgtcacccaagccggagtgcagtggcgcaatctcgactcactacagcctctgcctcccaggttcaagtgattctcctgcctcagtttcccaagtggctgggactacaggcatgtgccaccacacccggctaattttgttgtatttttagtagagatggggtttcactgagttggccaggctggtctcaaattcctgacctcaagtgatccacccacctcagtcttccaaagtgctggtattataggtgtgagccactgtgtcccgccaaaacatgaaatacttctaatatggcattgatgggcagatcttatattcatgctatgttgcaacatattaccgtgctatatgtccttgtgagaatctttgtctttttaaattaggaagatcctgatgatatttttatttttgattgattggtaatgattactgcaatggataaaatataactgaaatagatgaaaaatactgagtgtttatcagtaaaatagatttcaaaaaagataatactgatggatggaacatacacagagtgcagaagacgatgtatacacctttgttataagaaagagaaatacagcccctgacatctggaaactgggctcacactgacaaacctagtcccttgatgttaagagctggtcttgcacttacaggtaggccatactgttatcctgttggacatcaagcagtctcagggtaccagaatcccacaagatcattctacaacaataataaagtaaacaaaacaagaacactttgtaatcttatctaagcatagatgaaaacaaggtgactgttgaaaccgcaaattaccgaacatccccatttcttgactaatgtgaataacctcctactttcttaccaattagagctttagcctagcattagtctgccatccttctaaataaaatttatcaagataccaatgttagaattgtccccattctctgacatcgcttaatccagagaaaatccctgctccatctaactctcccgaaaattactaacataaacccaaatcctatagtaaatcctttcaagtgccctcttactgagactctccatgattcctcatggtatgtggagttttttttttcattattatgggcaaaaatctcaacatgtttgtccataggtgggacgagcatctggtcatctttggcctgatgagtgagtattggtaattgccacataggtcatttcaaaatcacttctaatttagcaaattttcatagtgcagctacaagggaaagattcatattggagtagtcctacatttacccaaagatttcttgaatggcaagaagctatttttagtcccttgacatgctattttgcatcaactatcaattatatacaagtgcctccacgcttgtatagaatgaggtgttcactatgagtatggtaccttaatagctatataaactagaaagatttttaaatctaaaaatatagtacatatccaaggtactctataatacatatagtttaaacaataataaaaatagcccctgtgtattcattacccagtctaagaattagaacatcttgttttgtatttttcattcccttgctttactttatggttttactgcatttggatgtgtctctaagtaacatgttttctagttttgtatttttgaatattatggaaatggaaatcatactacctgtattcttttgtgatgtttttatctcaacaacatgtttgtgaaatacatccatgttcgtgtgaataacattacattcatctacactgttgttacattcccttaatgcatctattttctggtcaacagacatttagattgtttcagtttataattttaccaaaaaatgctgccatgacattcttatacatatggcctgacaaacatgtatgagtgtgtacactcaatggtgggattcttaaatctgtggatcatgacctattggtaggtagtaactagcattaaaaacaagtggtgggatttttaatctgtggatcatgacccattggtgggtagtaactaacattaaaaaaaagtggagtaaaaagtgtcagtatagatatacatatatatatgtgtgtgtgtgtgtgtgtgtatgtgtatacttatacatgtgtgtatttattttctgagttgtgacataaaatgtatttcttattgtgacctctgccaaaaatgcttgagaagactacggcagattgtgcatctgggaatgaaattgcacaccaaacggtatgagcattttcagcttgacaagataatgttaaattcttttttatagtggttgtaacaatcaaaaccccactagcattgtataagtgtttcctttacttcatgatcttaccaacacttggcttcatgaacattttttattttttccaaaccgatagatataaaggaatatctccctatagtttcaatttgcattttactgcttaagtatgaggttgagcagcttttcatatatttattagctttttgtggttctttttctgtgatatgagtatttatgtgtattgcacaattttattttaggtgctggtcttttccttattaatttggaggtactctttatgcttcccttcatctctaaatatgtttttgctttgaaggctattttttctgttattaatacaattacatcaaatttcttttggttaatagctgcatacatgtttttccaacatttgactttaaacctttctgtgtccatatgtttaaggtgagtctcttttatgtggcatatgtattattttaaaatatagtatatgttatatgtattttaatacttgttatacttatatgctacatacattacatatgtgctgtatatacatatacctgatatatatactatatgtaatttttaacatttaatctcataatattgtttcttaaattatagagtttagtctgtactcactgattactgcaatatttacatttatttctattatcattgtgattcctgaaatatttgcatttatttattttatctgtagattcattaaagtgtatttttctcatcccatgttatcctttctactggtattcgtattatatgcttttttcattttcagtggttaccctggaaattataacatttatatttaactttgcaaatcaatagctaaaagaaacttggtattcttgaactctaaatattattttcctggctgatacataatttttgtcctttgttttagacatttcttattgtataatccaacaatttatgtcatctcatttttctttataaatcaatgtttgtttagatttttatatattttatcaatttcattgttcaccatttctttttatacctcagacctattttacctctcctgaagtatagtctttaaaagttcctttagtgagaatctatttggtgataaattatctgttttcattatgttgaaaatttctttatttcatcctcattcgtgaacagtgatttctgtggatatgcaattctagattgatagtattttctcccagcactttgaagatgtgtcattggtttctggatttcatcattgctattaaaaatcaactgtcatgctaattgtggttcttttgtaggtttccttttgccttcctggctacttttaagatgttccctttgtctgtagtgctctatagtttcaccataatgtgtctaggggtttcttttcacttttcctgcttggaaaggaagaaaggaataaatgtacaccagcatcttcatatggccaaggtccttgtttgtcttcttcacctctgtattcttagccttagcccggggcatgacacatagtagaaatgcaataaatatttgctgtgtaggccgggcgtggtggctcacacctgtaatcccaacactttgggaggcagaggtgggcggatcacttgaggtcaggagtttgagatcagcctggccaacatggtgaaaacccatctctattaaaaatacaaaaattagccgggtgtgatggggcatgcctgtagtcccagctactcgggaggctgaggcgggagaatcgcttgaacctagaaggtggaggttgcaatgagctgagagcatgccactgcactccagcctgggtgacagagtgagattctgtctcaaaaaaaaatgctgtgtaattaataaatgtataaaaaaattgaattagtttccttatgaataatagaaaggaactaatatcttatctcagagtatctaataagcatatcttgttgcagatgtctccagcagttaatagaaaataaaggagcaaaatgaatcttttggtcattattcttttttaagataagattacctattttcccctgtaaaactatagataatttaatttgactttacattcatataagcttccaagtgaaggcttgaaaagtcccagaggtttagtgttaaagaaaaccaggacaaaacaaaccctgaactgtcagtaatcattattcacaaataagtatagcccactgtgattttaatcaggcccattcttcagagtatgacttacagtgcataaagtctatgtcaagtcttgtgtttttcaaatactagattgacatgacagagagggatataaattttatagtgggtgggatttttattttcttttgtcttttaccccttctgtattcttaccactccaccctcaacacacaaacatgcacacgcacacacacaccccacaatcacagccaatcatatgcaatgctatgtttgttattccttggactctacaggttttcacccttcctcaaagccctgttatagttgacaagtatgagttctcttcagacaatttttccaagtataaagcatgtgggatttcaatacaaatcctgtctctgacataatacctttataactttgggcaaattgtttaacctatgtgagctttagtttccttgtctgtaaattggtaatggtaatagatacttcattgcttatagtgagaattagagataccgtatataaagtgactagcctattacttggtgactgacatgcactcactaagtattagtttcctgttctaccaagccttctgtctgcctcctgacaagacgtgacacctgagagggtgacaaaggcataatctcaacaatctgttctggtattttctctgaaatgacaaatgactcaagtgcattatctgagttgaacaaatacaagacttatagttattattctccaagggtagcaagaggtaatgactaacaattctgggaagatcttatttgtgttaggtgttggcagctctaagcatgcatggtaaaagtgatatggaggcccatttcctggagaatgtagactggatgtgtccactttcttctgtcacacatgaaactgctgtcagtatgctatctactccatctcacatccaaagaacatatcaaaaaaaaaaaaaagatctaaggccttggcatgccactatttagcaatttttagtcactgaactatagtattcccccttgttcttatttctttttgtgtactctttgcctcctgcaaaagttaaaaactcttcttttttgtaataaaacaccagagagcaaatattttaggctttgagagctatgtggtctaccgctgcaaccacttagctttgtagttgtagcacaaaagcagccaaagacaacacataaacaattgagcatggatatctttcaataaaactttatttatatgatcaatgaataaaggactccctatttaataaatggtgctggaataactggctagccacatgcagaagaatgaaactagacccctatttttcactatatacaaaaattaactcaagattgattaaatatttaagtgtaagacctcaagctatacaaattctagaagaaaaccaaggaagtatcattttgaatatcagccttggcaaataatttattactaattcctcaaaagtaattacaataaaaacaaaaattgacaaatgagacctaattaatctaaaaaattttacacagcaaaagaaactaacagagcaaacagacaacccacagaatgggagaaactatttggaaactatgcatccaacaaatgtttaatatccataatctgtaataaagttaacaagcaaagaagcaaataatcccatttaaaagtgggcaaaggacatgaacagacccatctcaaaagaagatatacaaggagctaacaagcatatgaaaaaaatattcatcactaatcatcagagaaatgcaaatcagaagcacaatgaaataccatctcacaccagtcagatggttattattaaaaagtcaaaaaattacagatgctggtgagtcgtggagaaaaggaaatgcttatacattgttggtgggaatgtaaatttgttcagccactgtggaaaacagtttggagatttctcaaagaactaaaaacaaaactattataccattcaacccagcaatcccattactgggtatatacccaaaggagaaaaaagtcattgtacaaaagcacatatacttatatattcacagctacactattcacaaaagcaaagatattgacttaacctaggtgcccatcaacagtagattggatcaagaaattgtggtacatatacaacatggaatactatgcagtcataaaaataatgaaatcatatcttttgcagcaacattgatgcagctggaggccattatcctaagcgaattaatgcaggaatagaaaaccaaatactgcatgtcctaacttataagtaggagctaaacattgggtacatatggagataaagatggcaacaatagatactgtggactcctgggggtgggggcaagggttgaaaaactacctattggatactatgttcagtacctaggcaacgggatcgtttataccccaaccctcagcctcacacaatatacccacgtaacaaacctgtacatgtaccctattaatctaaaataaaagttgaaattattttttagaagaccctatttatagaccctgaaatttgaatttcatatacttttcacatgtcattaagtatttttattttgatttttttcaaccatttaaaaatgtaacaatcatttctagcttgcaggctgtacaaaatagatgatggggtgaatttgacccatgggccatagtgtgcctaccttttcccttttgtttctgaattttccttattcatcttcttacaacctatgcaatttcctgagttgaatattagaacaaatatatttctatgttaacttatcatagtagttttctattgccaccttaactattactacagcttagcagtttaaaacaatgcaaatgtattatttcacagttttggagctcaaacgagtttgactcgtttctctactccaggttctgtaaggctgaaatcaaggtgttggctagttgagttcttttttctataaagagattctgggaagaatccacttccaagttcattcttgtggacagaatccagttccttgtggctgtcagaatgaggtgctcatttccttgttgactgttcacggaaagccattcttagctcatagaggtctcactttccagtcattgcctgtggacctctacacctcagagctttctcagcacataaaatctttctcatatttgcaatctgactttccattctgcattgtctttactgacttcctcttcttcctttgtgtttaagggcttatgtgattgctttgggcccatgtggataatctaggataatctcactattttaaggtcagctaattagtaacctaattccatctgtaatgtctgatcacatcagcacctggattagtgtttgactgaatagccaagaaacaggagacatctttcgaatttagaataccacaattgtcacctggatttccaacactgtgatacataagtctatagatcacttgaaatgtatccagaaataacttaacccattcaagcttttggttttggtaggttatatcttagatttgaccgtattccataagcgtattttatatagttactgttatggagcttatccaatagtctgggcttctcaataggtaatataaccacttgggagtaaatctatggtagacaaactatggtcttacctttcaatgaatacttttctccaaggttaacattttcactttttgccagtagtggaatggtgtttcatatataatttacctttgcctcagattccgaagcagatttcaggataattgctgaacaagcagatttcaggataattggggaagaaggttgacatatttttcaagagtgacttttctatttgagatccagctattgattttcaagtccaataagttgctgaatcaaatggatataatattctggggcttgaaatgcctatttgactctcagttgcttttcctcagccaccatatcagacatgtcaccaattcttactgattctcattctcagtgggccaagtgtatgtgtctttccctttactcctcacctccatgataccctgatttgcatcttcatcattttctatcctctttattgtttaactttctaatttgcctgcctacctctggtttctctcttcttcatatatttagccagagattatgtgattcaatctgaactttagaaaaactgctagaatgacattccacctctttacctcagcattcaaatatttgaccccaaatcctaccttttaactccagttttcaatagaattctccacaaatcctttaccgtagttacatagtcctatttactattttcagaacatgcccatagaggttttgggacaatagtgctcacctaatcagctaaagccatttcttaatttttaattagaaatatatttagtctaccgaatgacttctacagctgttaaaatccttgtgatatgccagaaaaggacttttatagcagcataactactataggttgaattccaggtattctaattcattccacaaatatttcctgagtgccagttactgctcctggaaatggtgaacaacacagccaaggtccctgccctcatttcactgatgataataagaactatgagaatatgaaaagaagggtaatgtgttaaaattatgagagagtagtcattcatttgaaaaacattaattgagatcgtggtctgtgaaagactttcttgtaggtactatggaaaacaaaagatgaagcagacagaaatcagttctcagagcatttacaacccagtcgaaatgagagggtagaaataatactgaaggacgctataagtaatgggagaagtacagacaaagaagaggattataagcatttcaggagggaagatgggggtgatttcatgtagccattgcaggtagggtttaaaagatgggtgtgactattcaaggatccttctttcccatctttaacattgaacttattaccaaatccaggcaagcacttccaccacctatgatctgaatttattactcctcttttagtcttaccattgccctagcatgggtgccatcatctgtctcctggactattacaatggccaacctgtctctttatcctattctctcatcagtctaacccactgtacatgttatatcaaagaatcttttcatcacagagatctgatcataagtctgatcacagagtctgatcatgacctctttttcattccaaacctttacttgatccctattgcttgcattgaagatcacttatccactaatgcagtggttaagaacttgagccccaggtcagacttattgggatgggatcctggctctgctacttaccagctgtgtgatatgaggcacattattttattgctctaagtcccaatttcctcatctataacattaggataatagtgtttacataaggttgctatgtggataaaaatatatgaagtatgaaccgtaattagcaagtacctagcagatagtaaacattcaattaatactggctattattatcaccataaaatactccagagattgagataaactttataaataatttgctgttttcagtttattagggatttttgagagttaattatgtggctaaataattgaatttcaatgctcttcccttttcccttgagtaggcagctaaggattataactggtgagtggttttttgaagaaaaggcaaaacgtttcaagcaagtcaatgttctcggcactgatgttgtccgacagtccattttaagaagaagtccaggtaattaaagcaattatgtggtttcacaactgttttcatctccatttggctaactaaataacttctctatgttatgtagttaatcagcataaatgagtttcttgaatcccttagggcatttcacaacttggtagcatgaaatctagatacgtaattcatacaagacaagaagaagtcagtagaaaacaaaattcacaatgattttccatatatctcacccactaagattttcaaagaaaccatttgtctccatcatagacagttctctttctgaatgcatccaatattttactaaacacttaaagtaacataaaacagatgaattaaatgattcacattgtgaaagcaatccttgatttttcaacaatatttatttccgatttcctttcaatgttactttttaaatccagtggttctcaatcaaagattgataatatgtaccttgtctccctccctcaaaatgggagcatttggaaaggcaaggggggcatttctggttgtcacagtgactggtgagtcaatggcatttggtgggaaggagccagagatgctaaatggcttgaaatgcatagtcttactgaatgaatactggcaccaaatgaaaataacactttaccttgacagtgccttttggtgcattcaaattacaatttagttaattaaagatggagtaaaccttgtgattgggagcatgtttctcgtatatggtgtagtaaaagcggaagaaacatctttcagcctgtttctaggcttatctcatctttcatccagaggagacaagtgcccttgtatttaagtctggcacatatggcgagaaggcttggaactgattccagtggtacttctgggtgtggcactagcaaggaaaggcttttccacataggtcacacagatccgatactacagagagatggtgtggagtacagttagaattaggcaatcagccatggcctcttcttccactcaaaccccagtaccttccagaatgtaggcagttcctcaagtcacaatatatttgcacagatgcccaccctcccaggaagtgtggcttatatgcccagaaattaggacatcatttctacaacctcatgctagaactcagtctccagggatttggagatcttaggagaccatgttcccctgctctaaaaatatcaacagaaggctgatgcagtcatccctaggaaggttatctcagtaaacctcccacagatgagttcaggatctttgtcttcagttaactctagaacactcaacaaattagaactaactgtgtgacagaaaaacttgggatgggaatggcattgccaattattatagacttccttgccctgagctaatctgggaaagtgaaagcagaatataaatttgctctcatttctggccattttgtatgtaaatttctcttctgattgtttgttaatgaggagctgaagaagtacagagccaagagcaaacccgccaggatgcagaaaagtcagacacttcacctgttgctgggaagaaggccagccatgatgggcccaagagaaaggggtaagacatggtctttctgagggaatttttgatctttattccagacacctctgaaatgaagactccttaatttttcaagtttgatgtcacttcaatgacccagaggaggtcagagactcaaacaaagtaacactttcttatcattctcctcaggaaatgcagttttaataattttcaataagtaaataaaagtcctgtctgacctaagcacagaagagttttcctttcatttgacatatccagtcttgcactatatggttcccattacttataagtagaaagtttcatgccaggatcagtctataaagaggtgacaacaatttctgttgtacaatgtcaatactcctcccctccaacctgtgtgctgatatataattttatccaaaataaagatttattaattgagcttaaagcaccatattccctatttaaaattcaggcttccttaagaaaaaaagtcacatttggccaccacagtaacttagttcagtaaatgaatacagaatatggatgccaagtactgagaataggaatgggaggtacataagggagcaagaagtttctttcaagggagaaaagtggatcccaaaatataggctataaggaccaaaaggaaactgcatttttcagtttttgtttctcatgcagctattggccagtttttgtgactgaagtagtgagagttctaatgtgcaccaagtcattttatggtcctttctgtttttttattattattgagatggggtctcattatgttgcctgagctggccttgaactcctgggctcaagcaatcctcttgccttggcctcccaagtagctggtactacaagttgtatgccaccatgcctgcctaactttatggtccttttcagacagcattgcttcattctctcagtagaatgcaaagtgagagggcattagtgttagaagatttatctggctgtacaaaatgtctagggttcttttagaatcttgggctgtcagtaggaatacaatctaaatgtcatctaactcaagcactcatgacaaaccatgttttcattgatgagcagagatgagttggaaagatagcctagagtatcctgtatatcctatcctatgtattgatccttcctaccatcttgagttcatttatcactctttgggtcacccacaatgctttgtgcctttgcaccaccaatcatattgcactctgacaccccctcaacacacacacacacacacacacacacacatgcacacacttaattgtaagcttctttagtggtagaccagtggtttctttgcttctgtgttgcagtatctagcatggcacctgactcatcaaaaacaatcagtggcttgattgaataagtaactcagagcccacaaatgcctctaggagttgtcatttgcagaccccagctcaggcatcatagagtaggttacagaatagtggacttggagataggagacagtaactaactcaccatcacaatcaattatgcaaattctgaatcattgaaaccattgtagcactgggctgagccttagattctgattgttctcagtcatcaaggaatataacatctatttggggagaaaaggtacacacctgaaaagttactaagtataaaagaattgcaggaaaatttaagatggcaatgtgagcttcctaaaagcctttctaaaacagaggagggtgttcaccacaagagatatcctaaggttataaattactgagtacatataaataagcaggtggacaataagtgccagttgagtataggagtcatccagaaagacatcaaattgtacatgagatttgaggaggagataaatggggttcaggatcacaaaacggaggaagagtgactccaggcagaggagataccttaagtagaggacatgcatgaggtggttctcagagcagcataccttgacattatattaagtgctattctcaccaaagaaaaaatgtaattttccagtagattaaagcttcagatgctttgacaatgacactattccaggagtctttgaaacagagacaacatggcagattctattaagattgtgccagtacctttggaatccatgttttcctctagaaaactgtagaatgtaaatgaagtgtatctcccaatgccattacaaaaaggaatatagctttgattttcttattcaagtacatttggaaacacccatgttttgggcacatggtatcctggatcaggactttaagttcctaaaaggctgtttctgcttaaaccccaaataatttagtgaaattggaaggtaatcagattttatccaacatgaggcacaagaataaatgtcatggaagataataaagatgagtttagtcattcgttccacaagagttggttggattccagtataagccaggcatcattctaggctctggaaatctgtcaaggaacaagaaaggcagagtcactgctctcatggagctgcagtctaataagcagctacctcagtttgtccaagaggatcatcctggcttccctctctgagcaaagggagttcaaactctctattctcactattcctgcaaacaggcccaactcagggaatgcatcttctttctcaggtgacagtgctgagttctcagaataggcagtcttttgcttagtagtgacctaccagcaagtggtacggtcttgagagaacggcgtaaccttccccattatcacccttgatactgtattgcagaggcactgggaactctccagaacctctcagccctaaggctgctttattgaagaatcctttattattaaaagtactagaaattgtattcttgaaatgatatttttaaatgctttctttcttatctaattttaaatacatatatataatttcagatttcttcttagcaagttcagatcggcaaccagaggagaaatcataactcccaaaactgacactgggcggagctatagcttggacttagacggtcaacattttcggagtttaaaatcacctcctggttcagacaggtaagagtcatacagattgagcaatgatgtagcctgaggttaaggttgatatattcccattcatagggggattttaggtatctgtgaaatattaccacttggagaactcctaacacataatgtgaaaattcaggaagatattttttagttgatatggaaagcacgtaccctacttctagaattacagctattggaattgcctatgtcacctgcagggatgaaactttatattctggcacttggggctgcagttcaaatggaaatgtacagggcaagtaaatgtttttcattgacttcttgagctttttctatttaagctcctgaaaaaaagaaacctctgagtgtcaaatacattccttgcagcttttaaaaaattattaataattttaaatttgaatttcctcagagactttttcataaatttcacttcctttctagttccacctcttctaactggaggagattatcagtggagccaattgagaatgtcctatccacagatctatcacttgtcaagaaaaataatgagaaacacaaaggatagcccagagcatagtcattttatatcaggcgtgattttctgtatcctattggagcatagtcaagacttattttcatgattagtgtattatcaaagctagcaatgagaaaaaaatatccaccttcatatttcactggtttgtccaattgttaactccctttcgtttgcttgtgtctggggtaattttgcaagccagatagtacaagtagcagattttcttttctccttaggttaggaagaatgcaagcagaattgcattcttccctgtaatccattttagaatgcagaccaaaaaatttccttagaggggacactattttgactattgggttattttttcatggtgactctccatagctgtttcttttgtccctataacagtcctgcatgcaagcgttactttatgtaaaaccatacagaaaaaaaaaattacaaggaagcgtaaagtcatttatcacccattatcaaaatattaatactgtattcagtatttcccaaactttcaagaatgctgatatattcccttttatgattacaaactgttaagctatggttgcctttatccttgaaatagtttcatttgtcttccattgaggtagcttcatgctgtgtcccacaaaactttctataaacatctcattttggctgggcacagtggctcacatctataatcccaatgctttagaaggctaaggcaggaagattgcttgagcccaggaatttgaggttacagtgagctatgatcatgccactgcactccagcatgggtgactgagcaagaccttgtctcaaaaaaaaatgaataaataaatctcatttttgtttttcatagttggactcctgactctgagatagtagtggtcaaaattatttagagacagtaagcaactaatttggtgttctttttgctcagcctcctgggactccatggatgagccaccttggctaacacttaaggctagcatttaagaaaggcaatatatacaaaaagaggaaagacaatgttccttgttttttgtttttgttttttttttttgagatggagtctcgctctgtctcccgggctggagtgcagtggtgcaatctcggctcactgcaacctcagcctcctgggttcacaccattctcctgcctcagcctcccgagtagctggaactacaggtgcccaccaccacgcccagctaattttttgtatttttagtagagacggagtttcaccgtgttagccaggacagtcttgatctcctgacctcatgatccacccgcctcggcctcccaaagtgctgggattacaggcgtgagccaccgcacccggccaatgttccttgttaaagaaaaaaaaaaggctgccagcctaacaaaattagattgtgctattttaagttatatgtcttacagttactcaacaagaataatagggagcatggtctccagtatcagtgcttataccgtaatggactctatctgcctcagtttactctttgtgtattatctactactaggcataaataaccaaaactataaagccatatggacatgcatcaccaagtactggtatattgacccaggagcttcttgttctttttgtaagctgaaagaaagtccctaagtagactttatcttaaattgtaaatacctgaaatggcttacacatagtcagaagtagccaggagtgctttggcttaagcatgttaagaacaatattttgccactaagaaagtgagtaaagatgctcaggagatcaatagagcaaaatgtcctttcccttgaacgtgcatttatcacagtgatgactcattaatggactgccacagtgagatgagttccattatttcaaaatgagtccttagaaaattgaggcaggaggtagcccatcttttcttaacttccatcatctgaagagactgtaagatcccagtctctttggtctattgcctgacccagcttactaatatttcccctttttcccttacaatgcatattttttcatggatcattggtattttcatggagcagctgggcttcggcattcctttttaaggctcacatcatataagagtgtaaatgatgttttatcagatgtgcagttggctttcttttcagtagtttcaaagcaagggaaagtatgaatagattaaagaagccctagcagcctctcagaagagcttgtcaaatggatgttcaccggttgctagggacttgacacatgagacaaagaatatttttaggaaaataaatgtaagctgtagttaataaacaatattattcaaggtagtgatttctaatccctacaaagttgtgatgagctgtcactgtggtatgatttacaagatctctaacttaagtcatgctctcccagaaacagacccctagacaaggatttataagcaagtgatttattattaatcaagtgattccaagagaaaccaggaagggagtaggagagacagaatagagaagaggaagaagctaaacaatggtgctagctccagtgtggtctgaggactcagcctgatcctgtaggagactctagagcataaactatatccctgagctttttccacattgaggagctggaccattgcactcctataccagtcagtcattgaccatggcctcccttgaatagagtctctagacttagcaagtgaagatacaggatgcccaggtatgtatagttgagactaacaactgttttttagtataagtatgtttcatgcaatatttgggacatccttatacttaaaattaatttttttatctgaaattcaagtttaactgcgagttctgtattttatctgacaactcttctataggggtgagggggagacaaactccagggcatttctaggcctccagctccagggctaaagggaaggtctctgaaggtggcaggtgacatccattagcagaaaagaactcaggatctagggaggagcatgcacagctggtaaaaggaatctgagggagatgccaacaatgttatctttaaaaacagagtaaaactagaactttgaacctaaaatgcattttgttcagtaaaaatggaggaagaatgatgctgtttctcagtagcgtttctatcatgtcattggagaatatggcaatatctacatggaatgtgaacagacggtgggaccttgtttggtctcgtaaccaactaggttctcatctttctgccctcccactcctccactccacgcacaccagtttcatccagttattcctaattgctctccagtggatctgggactgatggtcacagtctctgtgaagcttcacaagctgctttgctttggctgtgatccaccaaaagcagagaccacaccattcaaaccagcccttagctagttcttgtcctcatttcaagcactgcccctctctttttctctctctgtccaggaaatatggcactttggatattatcatgaatttaaagaatcatccattcctcatatctattattttagtaaagtgagtttattaaacccattctatcactaaatgatgccttctttttcatcagaaataaaattattctcctgtcctgaatgtaattttcattgacatctttgcaattaaggtgccaattaggtggcagcctcttactagaaatttgaatatagcaaggtgggagtgtttaactctgagtcaggaccacatccacaaagtcaacaatggtctgttttgcgtattagataaaacattacatagctagttgctaatgctattagcaaactccattccttaccaggcttaaaaaaatgttcaaatgtatagcatatctctgaaagtatgtacatttattctataatgatcgttcggtgactcaacaggataaaggctgtgagcattgtcctccaaaggaaaattactttcacctctttcctgtgcctttccctcctttgtcactgctaattcctttttttccattttaatctcctttgggtaagctcagccctccttaggaggagcgaggggtgggcaatcaaagccacaagctgtagcaaatgctaacagcctaaagcaattcgcaaaaccatggtggcctgagaaaagtgaattttaattccagggagcaactgacacatgataaaacaggagaggaaacatgaattcaccagagtattttgttatgctgtgaccttatcagtgggagatacacagtctgaagttgcaaaaaaaaaagaactttagctagaaacttctatttagaactcaaagccatccttttctaaactcatcctttgcccaccatatgcacaaatatgcacttgatttgggctcctttggaagacaatcctgaaataaggattcaagagtaagtaatatgttcaggatgtggtctaaggaaacagagataggagagtggggaaatgagccagggaagggaaggcaggcaaaaaggatatgtcattaagccagttgttattgtgggcaactagagctcaatctcactggccaattctagaaaaccgtgctgaatgtacctcagagttatccagttaagagatagggaatctggggtatttttacagcagctctttgttcaaaatttattgagggctgcttctagggcactaactctctggcacttccgacttgccctgttcacaggggctccatgctcccatgagtcaaaaaactcctcaggcagggagttctgggtattcccagtaaccaagattctgtgggtagaggtaagtgctgaaggcaaatgggcagggacactgagagtctgctacaacctccctcccaaactgctctcagacctccttcaaagacgcagtttgtcagaccactgttcagcccctgatttctgtttactttatattatgtgtgactttcctcattataatgtcaataatgtgagaaggtatggaggctcagtaattcagccacacccatgcttcattcctgtgatcaaatgattgtaagcctgaagcctcctccttgctgttttgtctgtttctccaattgtttcccatggattcactgtcttggcatgctctatttctatgaactaaatctaacaccttcccctcctccaatttaataaattgctcttttactcactgctacctaaatatgtattatgtgacatgttaccactctcagggtagctaagatacaatagatagcctttcttcttctacagatcattgaagagcagagatatgtgacttggtcatctatgcattctattcatacaaatgaattcaacacacagctctgttaacattattgacctagtactatatatgccagatggtaaatgtggaagttcttagacagtaatactgttccacccttttatgagcttccaatttagcaggaaggctgggataactaaacaaataatttaaatacaatatagtaatacgattttaaaaagatgttctgcgtgctatgggaaaaccaaagataggcatttatcctttcaaaggattcaggtaagcttcattgaggtgatccctaagcagcttttaagaaatgaggaggacttggccaggtaaagaaagataggaagagcattctacacagaggaaataaaaagtacaaaggaaaatagacataaagtagactgtgtgctgaaaagaaactgttcagagtttctagagtataaaaattgaagtatggtgtacaagagatgaggagatggagaggtaagttggaccaggatgtagatggctttggatgccttaatacctatcttcttatatgcaatataacatcctactcagaacaagaggttggcaattctgaactactaagtatggagtaagtatttgttccatttagttgctgaaagttaagttctgttaaacactccccttttttgtgtgtctatgggggaaggtagttggctttcttcttgcccccgacttctaattgacccaaggcttttcatggctgctggcctctctcctcaaaacggcttctggtcattatttagaaataagacatttgatcagaattttaatgggatgctaaaaaacaaaaatattatcacgttgagagtaccacctgttcttaagatctacttcttcatacccagctggagtcccttcctcatggtaactgtctcctccattttagagggagtcttcttaaagggaacaaatccattaaggaaacactaaacattttaaaaccctcaaacaaagcagcttttgttttattaagtcaaattataaagctatttctatagttaacattaggattcatttggcacaatttcattgagtgcccactaccttatactactcttgtcctctttccaaaaaggaaaaggaagatatgtgcgagtaagccatagaaggccagtggcttcaggggacattgcagctacagaagctgcttgaggaatttccatgtctttctcatctctctgcttccctaattctgctttgaagtgatcctatgatggctcacttgggcctaagtttaacacacaaacacccaatacctgaaatttacttcttttgggtgtattagcttctccaaagagtttagtttttaaatagactcatgtgtgtgtgtgtgtgtgtgtgtgtgtgtgtgtgtttgtgcgcataggcactgtggtgttaatatatatatatatataggttttcatccatagttcctgcctcccaacttccatagtccttgttatactgttgggtcactttaggcctcagaaaacataaactctctctctgaccttctgctgtccttctttcacccgccaaagcaggactctaacctgattatggttcaaaagaccctcattccggaaaccctgcctcataacctagaggaaggaatgctacacagagaaaccaagaaaagtctgaacagacaagccttgctaggtttagatcatgcactttctgtccaatcacatttttacatggttgtcaatcatgcctatgtaatgaagcctccataaaaatccaagaggacagagttcagagaacttctggatagccacacatgtggaggtgccaggagggtggtacacacagggagggcatggaaactctgcagtcctatccccatacctcaccctacgcatctctttaactgtatcttttgtaatagcctttataataaactggttgatgtgtttccctgagttctgtgagccactccagctaattaaacacaaagagggggtcatgggaaccccaaattgaagacagttggtcagaagttctaaaagcccggacttgtgactggtgtctgggggaggacagtcttggggactgagtcctcaccctgtgggatctgacactctctttgaatagatagtgtcagaatttaattagaggacacccatctggtgtctgctgcttggtgtgtggggaaaaaccccacacctttgttcaccagagacttccgtgatgatcgatgattgttgtagtactgtgagagcagaggaaaaacatacttagagtttttccccaaactggcatacacacagagatcaaaaaccttttctgtaaaggtacagataatatttttgactttgtggtccatatgatctctgtctcaactactcaactttgctctcagaacatggaagcagtatagacagtacatgaatgaatgggctgcctgaattccagtcaaattttatttatgggcactgaaatttgaatttcatataatgttcatgtgtcacaaaatattattcttcttttgatttttttcaaccatttaaaaatgtaaaaactactctaagcacacgggtatatagaaacatttggtgggcccaaatatgtccacaagccatagtttgctgacttctagtgcaacacattcactcactaagacaaagtgtccttcagtgtatcacagtctgaaccacaagaacagcttagctcttttcatgtcagtactgttgaattaaaaaaaaaaatagtggtagaagcagagggagcaatgcaggtggagagatgtctgagatcaatgaacttttatccacagcttagcacagtggttttcagccttggcttcatattggaatcacctggggagttttaaaacatcctggcacctagatgccacacccagagagtcccatgtgactagcctcagtatagtctggacatgggagttttaatggctccccaggagtttctaatgtgcatctgaggatgagggccactcatctcacataagactattaataaagacacagcacttggggatcaccaaagactagaagattgagctacattcatttttagttatctctttcccatttagcaggcttatctcactttctaactgcaaccttccttggccatctttcctgcatattcattgtagatccaaaataactataagaagttaggaaagctcataaacctcagagagaatattttgcattgtctctgtgttgtactgcacattagtctcattgtcccagtgagttttaggatctctcaggttcgtgctgccttaggagagcacacatttaaccatatgggaacaggctcaacactatcagccactctgggaaggttggatcctgggaaattatttcctggctacaactcctaggagacctttatgtaaagcagaaaggcaattacattgtaatctctaccccctatccttggatcctctgtctagaaatggatgtatctgggaagctgttatcaagattttggagcaacatggtgctgtgctgaacccctattaacctcaatagggaaactgccaggttcaagagactcagagccagcaaacgagacatacaattttattagcatcttacacacaggggacagagtccagcagtggtgggctgggcaggaaaaccataaccgcttgcaaataacaatgcagtttatatagcattttcacttaaaaccttccccctaaacgacctccacctggaaaccttcatttaacccaaaactcagggcctcaatccccggtatggcccatgttccatgagaagggccaggggctcagatgtttttcataggtaagaaacaaacctcagggctggccactcctggattccctagcttggaacaaacattcagatgcatctgccacacagggtcattgtaagagtatactgaaatgattgctgtcagatgtgtttcccctacccatggaattagagataacaaaacagaaggcttttaaagtatatttcataaggtaaagtaaattaaactttttcctaatctggaaaatgtgtctttcagcaacccagaatatccaaactcccagacagtgacatatccccacatttgggccttttacagtgagataaatgtatctctttcttgccggtttttacttaaccacattttagcttgaaggtttgttggcactgatttatcatacttcttatttaaatctgagtaacattatagctggattaaaaaatagctttttcttagttgacctttacacttcacaactttaattttgacttgacatagcttttatcattttccaatttaagtggcaaagattcgtgtattttatgtcatattttacataccttctaaatgagttggcacacaaatatttatgataatatgccttattagactaaaccttttttgagtttaatcaactggaaaaaattttttgagaagctcacagtaaatgtcagggacaaatgtgaaattctatgtcatttttgagataatgctgctggcaatgataatttgcagtagctgacttacaatcacaagaattttttccttattacaggataacttcttgaatgtcatcaccacaattaatcaacttctgccagagcttctacataagtagcacttttggtttcagcaaggctaatccatgatggggcgtttctcaaaaccacctggctctgggaggaccttccgcacacacacaagcagaaacacccacatgagtccctttggttcataacttcttgggtcatttctgcaagattgacccctgccctttctttttaaaggatattttacctgaaacagtagggagacatatttctgtgttaacattgttctaaagaacctatggtcacagtacagcatcaatgggaaagtctctatgcctctcctaagtagaacctctgagatgagcagaatacttggaagggtacaaatatggctaactgttgtcaaatgtagaaatgtcatgcttcaggtagaagggttcaggaaaatcaccaaagaaattagaattccaaagtgtatcaatttacttaatcacaaaattttactctcttgtcagaatcaacaggcacagtcttagagatcttctcagctgagttcatagcactgtaatttacttagactgctatttctacaaagaggaagccagagatcctttctgcagagactgtttagtaaaaaagaaaagccaccctttagtaaccactctttagtaacatagaaaattttcataattctcttaatcaagtcccaagaaactaattcctagctctttgctcctttgattaacttctgtttgatagttcattctataaatgcaaaacctgcctggctggaatgatttgttcttagtgaaatgatgagtaagcagtatgagaaactagaatggtcacaggctttgggtagactgacaatactgtttttatgctgattttatcacatgctaactctatgatagcatagtggtatgtcggtgtgtgtatgcatgtgtgtttgtgtacatgcatacatgtatggaataattaacctctccaatactcaatttcttcatttaaaaatattaaataatattctaaaacatattttacaaggatattgggggatggaaaatggctaacacctagaagatactaagtaaatgccactgctattcatgattattgaaggtggtggtagctggtaatgtggtccaaaagaaatttggttttggtgacttctctggtgcacagctttgaaaaaacttaggagttgtggttgacagttctatccaatggtcattgcctattcttctgcctgatttatcttctagtaatgatatgtgcacatttaaacattcttttaaaaaatattcctttattctatttaacctttcctcttattggctcaactgtaagtcctcatcactattaaccactgctggtatgctttaccaataagatgtgtactattatatgtgcatttgtaactcattaagacagtaactgagagagtaaaactcataagggcttctattttaccacttagcatattttgtgcccactgagggaaaagaataaaatgggaacaaacacttctcttaaactccgacttgtcaaaatttatgttgacttatgaagctcatttaataagaaaattgtgaacacctcaagggcaggaaccactttttcatttattgttattggattgaattgaatagttttagcacacatgaaagtgattcaagcacatttaccaaatgtcattatttttgtaccacatttattaaatgtgcaccatgaattagacactaaaacaacacagagaaatgaaatataacttctaatctttgattaaatatgtactgagtggcttctttgtactaaggcactacaaagctgctggagatacatgacaattatggcatggactctgttcccaaggagttcatagtttaatgaaacacccaagctcacatatgtggatccattagggagccaaacaagacattttgcagtcaaatactaaatacagtagtctggcaaagaccgtaagtcaataggaattgagtggaacagaggttgacaaggcttatgcttgacaggaaaggcctaatggggaaggctggacttcatttgcccttgaagactgagaaagatgtgtatagacagagagtggttaagagggcataacaagtggagacaaggtaagcaaaggcctcaggaggtggaagtcaagatggtgagctgagaaaatggtaaggaacccagactggctgagagaatgctggtaagcagaaggaaacaaaatcagaaagatggggtgaagtttaattactgtggggcaaatggggacaaacctagtgatcccctcagggcctttgaggaggaaggtaacatgatagtttctaagcagttccagtgtgactcttgtgaactcagtgcggttcatatgttcttatcagtttcctcatcagctttactctgcctgtgtatttggttgctgctctgcttccatgttaaagtcagaatatgctttctcatttaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagtaagtacacaaacctgatgaacaccgtattagttcattctcacactgctataaagaactgccagagattgggtaatttataaacaaaagagatttaattgactcacagttctgcatggctgcagagacctcaggaaacttacaatcatggcagaaggagtctgtcaaacacttataaaaccatcaaatctcgtgagaactcaccatcatgagaacagcacaggggaagcctcccccatgactcactaatcatccgccaccaggtccctccctcaacacgtggagattgtggggattacagtttgagatgagatttgggtagggacatagagccaaaccatatcagacacccagtctctgaaattcaacctcaccactgcagcatggctaggtttcaactctgtttgtatcagagcatgttctttatgctgctgaaaggtagaagcttcatcaggactgaacctcctgcatcttagctcctggcaggaaacccaaaatgaaaaagggaagagaaagaccaggttcaaaggtagcacttgtatgatggagttttaaattgctatatggcttaaataaatataaaacattttagaaggctctgattttgatcctctctgttacttcttagagaaaatattcataggttgagtgcacaaatttttccaaactgatttaaatctggaaaagtagaacttttatctagtttttaaagtagaaatttttattttcttttctatacatctgttaacataggggtcaacacataatgaaggcttaaattgcattttatatttatatgtgatcaattatattttctactggttttctcttttaaaagagaatatgaaaaaagtatttggggaaaaatattctcttttattaaatattctgttggaagttatatttggaatgaattagcatttgtgagatttttttatttagcaggaagctccatccacattgctggcatctatatttgataaatctttatatgagcagtgagttcatacaatacaaacaattatttgactcaaccaacatttaatgagaacctactatatgacaggctctagtcaagcaaagacttgaaggaagtgaaagaattagcaatgtagttttctggggcaaggtgttccaccacgcagagacagcactgatattcagcaggtacatgcagggaaggctgctctacttccttgtagctggcctccatcttgattggtcagtgcccttgctcagccagtttctaaaatatttttaatgcctctagaagaacagccagtgtggagcccctgaggtgggagcacaccgggtatgttcaaggaagaggaaggaggccaatgcagctgtggtgaatgaatgaggcaaagtgaactaggaaatgaatccaaagaggtcatagggctggatagagccttgaagagtgctgtgtgcagtcagcattcactctgattaagatgggggaaactggaggttttagagcagaagagtaacacaatctgccttatctttaagcaggatttgggggctgtgctgagaagcagctgtaggagaacaagagtgaaagccagaaaagcaatcagtaagccattgtcataccccatgtgagagattgggttttgaaacaaagagatagtggaggtggcgagtagtcaaattccgttaaagcattcagacagactgaaaaacagtaatagatttatttaaacatctatagtctaaattgtagttgtgaagataaaaggcatatttaaaacttcataaatatttatgctaaggtcagcaagccatttctgttcaatagctagaaaggtgcatggatagttgacgaatacactcacctcttggaatctaaaaaggaatgatattcaaaccacttagtgaccagtctggcagggatgttgagaaatcacaacagacactggcacaaggctggggcagtatgcgggggcccttctatgtcatgcactaaacctgaattatggggaaacctgggcttatagatgagagggagcacagggaagtgggaggtggactgggagtagtgctgtttattaactgacacagaagtatttttaaaaatttaacatctagtacagttgtcccagtgggtagcagctgacaatcagtccaatgaccaataagttaatcaagtttattctcacaacaaggtttatctttctacgtacaatttgagattattaggggggaaatcacccttttcatgtgctaataccctcaaaactaacagcccctacttgtgtatttctttgttaaacagcacctagatctctgcaacagaaattccctgcaatttagtagagtatatatacatatacataggcagtgcctatgctgatctcattcttgcaatctagctggtctaagctggtcttttctaagagaaaaaaagaaacaaagagaagtactttctattgaataaaaataagacagcacagtagtttatgaagtacatttgctctttcattaaaagggaagtatatagcattagatggcaagtatatagcattagatgatgagcaaggtaacaactcagtttctcccatttcttagcatctctttgtttcaatgttcttttctgctctagcatgaaagaaaatatattagtcagggatctccacagggatagaactgataacatatatataagggagtttattagggagaatttgctcacacgattataagacaacatcccacgataggctgtctgcaagctgcggaaagagagaagacagtaggatggctcaatccaagtctgaatgcctcaaaaccagggaggccgacaatgcagccctagtctgaagctgaaagcccaagagcccctgggaggctgctggtgcaagtcacagagtctaaaggctgaagaacccggagtctgatgtccaaaggcaggaggaggggaagccaagtgtctggtgcagcttgggaagagaaagagtgagcagactcagcaaacaagccgcttttccctgttctttcgtgtgctttgttctagccacactggcagctgattggatgttgcccactccacactgagagtaggtcttcctctctcagtccactgactccaatgtcagtctcctccagcaacacccttacagacgcacccagaataatactttatcagccatctaggcatccctcaacccaatcaagtatacacctaatattaaccatcacagaaaacttttagagcatgaaagtctctaacctgtcctctactatgatgcaacctattaattttaggcttgacaccctgaacctccagggtatgtattgcttgttaatgacagtgcaatattaattggcctattagtgctcaatactaatgatactcacagatcacctgtgggaaaacttgccattaacataattgcctccaaggaacttggtcttgcttcattaaaggactccatgtgtgaacaactttttgaagaggtgttgaaaattgacctaaactaatttatcagtttgacctctgtcacactcctgataaacttttcttgtttatggcaattagaggaagttaggagctatatacctccagctacaggtattatgtgttggagaataataagatactaaaaacagtctaaattgaagctgaatcaattagcatattaagcaagtgaaagccacatttcactgtaatgagttcatcagagtgtccctgaatgtctaagagatgggcaacaaggagggaattattcctctaggatttcaaaaggcactttttgattgtttacagaagggagaattgaaaaatctgttttagatttgatcattatcataccatgatgtaatttgaatggacacttaacctcagcccagttctggaaaggtccaaaatttgttatagttgttgttttaacactcaagaaagcttcggatgaggcagcagtcaagccctgccttggtctatggcagggcaaaggtcacagacaaagttgggtctatggtcatgggcgaagtcgggacagaattttctttaccatatgttacaataaatgcaagtcccagactgaattctaccacatgtacaagcatttattaacaagcagacaccacacaaaaaaaataactattcctgtgagcttgggaagttttctctctttatttttttatgaacattggtaagtaccatgcatgaaagtcattccaaaatagatgtaaccacccatattctgaccagccagccttctagatggaaaaggtacatgacatcctgttaaatgggggtggaagaggtaagggatggttgaagagagggtatgttgaaagagggaacaaaataggaccaaacagagttctaagcttgagtgctactctgagagtgtgaatcttgacagattattatacatccctcatgtaagattgagggtacctgtataatcttccttattaatcatatattagaacactcattgatttggggaatgagaaattgtccggataccttttgcactaattaacaaacctcttggaatggattttggatagcaattattgatggtaaattttgaagttacatggactcctggtgagggtccttcaaatgtcaattagctcctcctaaataataatacatataaaggtgtttatactgaagtatatttatgtagatgaattttatagtaaattacagtcagtataatttttttctcatttttactttgtgggaaggagtatggttttgaaaattccatggatttggctgctattgaaggtacctctcaggagctcacaaagagtcaccgcagaaacacttctggcacaccttccatagcagtgtctggaacctctctctcctcaggtgggtatttacaatgtgcctactttgttgtttaaaatgactaaatcaaatggaattgactgctatgtgtggtattaagtggatgtttcatcctttaaaaaataagcattcccttctttgacctatggtggtaggccactccataagaactgcttgaagatagacccaggtaaagctttgggcaccttacattcatgaaaattccatttatttagtacatactcttgccaggtatcatcactgagtttcagtgctacatcagaatatcaatatttgaatgaaggaaatataaattattccaggatacatttgctataacagataagaatgcttgctcagagttcaaggaaatggtagttcaattgatatagtagtcagaagttccctacatatagacaaaagaaaatcattctgtggtttaaataagaagttatttgcaagcagcactaaagtattaataattacccctttcatttgcatggtacactcaaatatgtcattttacttcattatcacaacagtcctctgaagcagctattattcattttgaaatgttaatagctatgactaagaaaattcttcggagaaatttgtcataattttgaagcttatgtcccatacatggaataaaaatcatgatgcagtcttcaacattaaaaagctacctgtaacctaatgattatatatgcataaagcctaaggcaggattctgtttgctgaactgaggggtctcttctagccagccagctcccaaaggattttctaaatgtgtgtggttattgctacattttgctcaggagtaaaaaagctgttcacctgttaattaaatttttaaactagtttagaaaccaacatcatagggtctactactactacttctactcaacagctcctgttaattgagtacgtactctgtgtcaggcctatgctaagtacttctgcattatttttttcatcaattcaaacttaagtacttgattactctctccaatctttctcatttataagtaactatattgatctcagtagtgctttggtatagaactattttgtggaaataagctgtcctgacttggtaagctgtccaaagcattactaagaggtgcattgctctgtaacttatattttcaaaaagtgaaaacaaggtgttcttctgatgaaagactcttctggtccattaagaaatagaacttcctctcattgcatctatagcctctcatttttgtgtgaaaagaacttgctatatcacttcaaagtggcagtttagaataggttgcattgcattttatgtcaaatctgaaaacacagtgaattctctaaatattgcaagcaagaattgttaatgtttttttttctaaatttaagggcccattctaagagagttttttaaagtctaggagcaaagcagttgccttaaacagcttaaaacatagcattttacagtagaacatttaacctcctgtgatagaaggaaacatgaacacctaagtgtaattcggtccaaggcaattaccaaaatattattaaaaatagaagtatgttatcataaacagcatgaagttactgactccgactgttgctttcatggcactatttatgatctgtgcctaaaaagaattgaaataaaggtgaaacacttggaataaaaaatgaaatcttctcacaaaacaggctgactcacgtctttctttttcctttccaccttccagatcagagtcgatctgagttagatttgagtgagtcatttacagaagactcagaggatactgtaagcataagaagcaagtctgtccctggggctttagacaaggtaagttggatgtggaagaaaatataatgaagaggaggaaataagggcataatcttgctccaagtggtttcacttttaggtgatgatgagttgagagtaaagagaggatatacaatcatctcttcctgttagtcttcacagtcaacacataaaaaccgaaagaataacttagaaaatataatgggtaatcatgttaatgagtgaaggttatgtctaagaaaacacatgttggagatttcaatttctggctaaagtcttatcacttaatctaaacctgggaaatgagagatcctaacattttccttagccaaatattattagaaatatctgattacatatttatatcaacattgctatatctcaagttaccaccaataaattcacttctaaactgagacaaaattatgtgaaaattaatgtttcagtgaactcatttctagaatgagaaggttaaattagattattgtaaaggttatttcccagtctaatattctgatattcagatttctgtaattgctataataaaatacggactccttggaagaaatagaacacaaatgtaaaatggtattgatagtttttccaaagcacactaggaaacttagagttctaaaatgaaataatattttctatagtacaaaaaactgggaaaatactttaaaatctacctccaaaagagagatgggcagtgagattaaattatttcaaagtttactcatgttcaacctttaaagaattactaattccaacattattaaactattaaactattcgtgatcttagaaaaccattgaaatcttttcattcattgtatgcagccagtataatcttgacactcagacttgatttttaaaatagtttgaaaaataaaactacaagtcaaactagtttacgaatatacatgcaaaactttaaatataatatcaattaaaatctagcagtgaataaaaatagcaataagtaagttttatgctaagtatgggtggaagaatgagtctatataagaatatttgtcagcataatttatatcaatatactaaagaagaaaatgacatgattctgtatgtagaagatactaaaggatctacaaaaatatgactagaactgataaacaagttcagcaaggttgcaggagataagatcaatatacaaaaatcaactgtatttatatatactagcaatgatcaattggaaaatgaaattaagaatataattccattcataatagcatgaaaaatatttttcaaaagtaaggaataaattcatttttaaaagtgtaatacatgtgcattgaaattaacaaaaatatttctgaattaaaggagacataaataagtagaaacatattctgtgttaatggattagaagattcaatatttttaagatggaaattctctccaaataaatttgtagacaatgcaagcccaatcaaaatacaagcaggataattttgtagaaatagaaattattattctaccatttatatgaaaatatatgggacccagaataacaaaatcaattttaaagagcaaagttggaagacttatactactagatttaaaaacttactctacagttatagctatcagtacaacacagtattggcataagcattggcaatcagtggaatagaattgagattccagaaaaaaaaaaaaaactttatggccaattgatttttggtacttcagtggggaaagaataaccttttcaacaaatcatactgggacaacaggatatccaaataccacaaaacataaaagaactttgactcttaacatataccatgcagaaattaagcaacgcaaaatggattataaacctaaatgtaagaacagaaaccataaaattctaaaagaaaacctaggagaaaatctccatgactttcagttaggcaaagaattcttaaatatggcactgaaagcatgatgcatgtattcaagaaaaaaaactggtaaattaaatttcatcaaaatgaaaaatgtttacacttcaaaagacaccactacagatgtgaaaagtcaagccacagactggaaaagtattttcaaattatatatttgttaaaggacttgtatctagaatatatttcttaaaacccttacattcaatattaaaaagacaaataatcatattagataatgggaaaaagatttggatagacatttaatcaagaagatttacaaatgcctaatagctgcattaaaatatgttcagcaacattagttatcagagaaatgaaaattaaaatcacaatgagataccacttcacacccccttgaatgggtgtgattaaaaagacataataataagtgttgatgaggatgcggagaaattggaacccccctacattgctagtggtaatgaaaaatgctacctacagccattccgtaaaagagtttggcaatttctttaaaagttaaacataaatttactatatgacatagcaattttgatcctaggtatctacccaagagaaatgaaaacatatgtccacataaagacttacacgcgaatggttataatagccaaaaagtgaaaataataatatctggtgaatagatggaatacaatgatatattattcagaaataaaaagaaatgaagtactgacacatactacaacatgcatgaaccttgaaaatattatgctaaatgaaagaaaccaggcaaaactacatatcatataattacatttatatgaaatgtcaatgaaaggaaaattgatagagaaattaaagcagattaatggttgccagggagtgaagaagtagggactgactgcaaacaggcatgggggagcttattgggttgaaaatgtactaaaactggattatattgaagtttgctcaactataaatttgctaaaaatcacggaattacatgcatacaataggtaaattttatggtatgtaagtcatacctctataaagttgtgggagaaaaaattagcagcaaggaaaatagctggaaaagtgataattgttaaaactaggtaatcagttataagggttcattatgctatgctttctattttgtgaatgtttgaattttttaatatccacttttgaaaagaaagtaaagaaacatgaagactggtactttatgtgatgactactgggtaattgtataccaagaaagagcaaaacataaaaatatagaaaaggggcaatttgaaaaaataatagggataatagggatgcattttttcagaattaaagagcttattagtttcggcagctttttgctgaagtttttagagtgttctatatataaaatcatgtcatctgcaaacagacaattttacttcttcctttccaatttagatgccttttatttcttttacctgtttaattgctctggctaggacatccagcactatatggagtagaattggtaagagtgggcatactgtattgtttctgatcttagaggaaatggttttagcttttcaatgttgggtataatgttagctaagagcttctcatgtatggttttatgttgaggtaaattttttctttatctcatttgttgagtttttagtatgaaaagatgttgattttgtcaagtgccttttctgcatctattgagatgatcatatgggttttatccttcattctgctaatgcagtttatcacaactattgatttgtttatgttaaaccatccttgcattccaaggataaatcccacttaggttgaatgagcttcttcatgtgctgttgaattcagtttgctagcattttgatgaggacttttgcatctatggtttatcatggatattggcctgcaattttccctttttttggtagtatccttgtctgactttgctatcagagtaatgctggcttcataaaattagtttggaagtgttccctcctcttcaatttttggaagaatttgacaggaattggcattaattcttcctcagatgttcagaagaattcatccatgaagccagcactttcttacaagatgctattctacaagatattccagctcatcttgtgggctcatcagtgagaaaaaggcagctacaataagttctcatttaacatcatcaacagattcttggaaactgccactttcagcaaaatgacatataacaaaaccatttttttcctcatcaatgttttaatgaaatgacattatttgaggacctgctgcacatcctttcacttaaaattacagttttcaagaacctatggatgacgttaagtgacaacttaccataaaccaatataaaaataagcaaattttgaacaagtatttcacaaaacaggaaatccagttggctgattatcacaaaatggtattcaacttagtaataagagaaatgaaaattaaaatcatgaagactgtaaacatctactggattggcaaaaatgaaaaaaatatctaacaataccatctgtttgcaggcaaggaagtggagcaaagggaactctcatatactactggttagactgtaaattggtgtaactacttctgaaaatttgacattatctttaaaatgatatagataagcacgtggagatatgttcaccccttgacttgacaattcctctcactggtatatattcaagtgtgtgaacatatatactgtgttgtgtgtatactgtggtgtgtgtatatgcgccaggatacatattcacagaatatacatatcagtgttggtcacaatagaaaaaaatctgaaaataacccaaatattcagcaacaagagaatggataaagttttggatatcatacaatggaatattaaatgacaatataaatgaacaggctacaaaaatatgccacaattttgatgaattttaaggcaatattaagcaaaaaaagcaaaactcaaaggaatatatagcatttaattacatttacacaaagtacaaaaacaggcaaaacgaaatcattttgtttcagagtatacgcttatgcagttaaactataaataaaagcaagaatgtggttaaccataagagttaaaatattaattattcccgaggggagaaggggcttgtgatatggacaggatacacagggagcttctgcttcatcatttgattttgttattatactatatatctatgttttatgtactttttaatatgctgtatcttataataaagacttttttaaagcaagcccagaagtgtacatcataatcctgatttataaaactatagttaaaaaaattcccatgaatgtatacttatactcagatttgtgtatgtttttatatgatttttcacataaacaaggagaaagacatggaatgtaacatgtgcagcaggatgctaaatattaatttcacctggtgtgaaaggaggggaaggaggagaggagaagcaaaaaagaaaagtgcccataataaaaagcagtatgcatgatacaatctatctatgtgtatatatgtatgtgtgtgtgtgtatatatgtatgtgtgtgtgtatatatatatgtgatgatataatcaaaaatattgaaatttgatcattaatatgttaatgagagacctaagtttttagtttccatttatctatattgcttgaaataattttactaggaaaatacatcacttaaataactaggcaaaaaaaaaaaaagccattttatcatgaaggagaaaaagaaatgggaaaggaaaagtagaatctgggattggagatgagagtccagtatctagttcatcctagtggagagatttttgagatatgctttaccatcttggcagtgtgtgtgtgtgtgtttgcacacacacacaaattttttttaattttaaagtaacgtaagtacattgcccaacatgaatcaccttagaggtaggaattgaacccaggtctgtatgattccaaatttcatgttctttcaataaagtaagcaccattagaaaggagacctcactctccaccccctatccctgcccacttctccgatggtataattcagattgaccggagaggaaaagagaaaaacctaggaatggagtgatttctagaaattttttatctgattctcaaatatttatgaaagaaagtggtttctcaagtgaaaaaacattctagaaaaacaaatcaaccaacccactgatttttccctttcttttttaggactccttggaagagactgaagaaagcattgatgccttagtgtcctcgcagttatctacaaacactcaccgtctggcaagtggcctatcaactgtaagcagttcactaggacatgtggaaagtttcttttccctctttttgattttctgtgcatttccaaaggagatatgaatgttcttaggaaaatgtgtgataatgagttaaaagtcattgtaagatcctgcttgccctttgcccacagagtacatttcagtctaatttggtgtgggttttttctcaggctcctgatttcttccttcttccacagtcctcacccaggttttaaaatctcctcactccctagttcaggctcagtcagctcaagcctataaattatttttcaattatctgctgacacatttccctgacaccattctctaaacttcccagctgtcctccagactgctgccagtcatttatcctaaaacacatgcccaatcaggtctgtcttctactcaaaacccatccatagcttcccactgcctacaaaataaagtcctttcttactttagtgttcaaggccttttttgagaggaaggccctgtgtccttgtatctaactgtgtgtaagtctttttcttggcttctctgatttctgttgctctgatgctttttttcttttgatctttggatgacttctctaaagagttctcaagcaggttctgacaggaagtggacctacctaaatgtgcctgatgctgactcagacactgtgagttttcaacctttcctttttgttctttccaaccatacttcacaaatttcatggtctgggaactatgattaagcaatttgtcccacatttatctttttccgacttatatacaattaaccagaggttatcttctaaaagattgatgagatgatcagaaaccaagtattccaattcattaaacattggaatctgaacaccactcaaaagacacatgctctaaaatgattaactatcaacaaaacctttgaagtaaacaactattttaaatcacagccttagcttggttaagagcatatagtttagttagtagtaaaattgccataggtgtcttagtttctcacaagcctccgtatttgtgggttcctaaatttccttctatccgtaggggccctctgcttacagaggattttctttgaaaatgtggctacagagatctagtatagacacaaatcagtgatataaggaggtaatcaggtatggtggggtagtcctcagactagaaacttggagatcttgctttatttcttggccataccaacaatttttgtgagccagaattttctcatttgtaacatgagtaggttggggtttattcttgaaacctttgatactcaaagcattctctatggaccagcaacattgcatctctcggaacagataccccaaaactttctcagttcaaaaagcccctaatgtctcagtaattctttcctggcactcctacactaaaagtagcacctgactagtccattcattaagtagttagaaccaaataatgtaataagcagtgtatcctaacaacttactagccatttgtaaaaaaatgctacaagtgaaagaaattgaaagaaaaatagtatttttatttcatccttaaatagcacctattacttaccactaataggatatgtgtgcctattgagcactacacagttaccaaatcttggaatctgattggacatcactactttcatttcccatttcacattgatttttatgcaatacttgctttttgttgcagcaactgccaaaaactcagcttcagacaaataggagttcattgaaaagaataaagtgtggtttaaagttgacactgtgaattactagttagtggcttacatggtgtctgataggtgttgttgtgtttcccttgagaatttaaaatatttctgtgattcccctgtgagtttgctgtggtgctctgtggtacctcgatacacagtttcggaactgcaggcctaggagtttgttagaacagccaaatctcagacctcaccccagactgaggagataagcgttttcagtttaaaaaggtatctgggtgctgctcaaagccacctgctaaacatgaaaattctgttgctttgttttaggaataagaaagacagattaggtcactcactggctttctttaagctgtaatttccaaataattatggaattattggtctgctcttgcccgtgaagaagcttagaagacatgtgaccacatcacccacatcctgttctttggtcagtctctacttccagaaattggtggaacataatggcttttaccaaaagcaaattatgaaaaagaagacagtctaaggtccctgtgtatttaccatagtcttgacttcccagtggttcacagaaaagtggttttgaaactattgggtcatccacgaaagacctccaggtggtcttttgtgacagttactgagatacatagttttcatttctagtgccaaaggataattttattacatttacagtagtcacctttatccacagaggatacattccacctaccccagtggatgcctaaaacctcgcgtagtaccaaaccctagccaagaaacaccaaggtcacattttcacttaaagaaagcacttttggcttctctttgacatatgtaaattactaccatcattactcttacactgtggagtcattattaagtaaaataagaatgagttgaacacaagctctgtgatagcaggacagtcaatctgataactgagacagctaagtgactaatgggcaagtagcatctgcagtgtggctcctacagtgtgtccaactggacaaagggaggcttcacatccagggtgggatggagcagtatgatgtgagagttcatcatgctacttgtgaaccccaaaactctgaggcatgtctcagttaatttagaaagtttattttgccacggttgaggaccggcacccctgacacagcctcaggaagtcctgccaacgtgtgcccaaggtgctcagagcgcagttttgttttatacattttagggagacataagacatcaatcaacatatgtaagatgaacactggttgggtctggaaaggcgtgacaacacgaagtggggagggagcttccaggtcataggtagataagagacaaatggttgcattcttttgagtttctgagtagcctctccaaaggaggcagttagatatgcacttatctcagtgagcagggggatgactttgagtagtatgggaggcaggtttgctctaagaagttcccagcttgactttttcctttagctttctgattttgggtgcccaagatattttcctttcacatactcaaaacagcatacaatttaaaacttatgaattttttgtttctggagttttccatttaatatttttgaaccgcagttgaccatgggtagctgaaactacagaaagtgaaactgtggataagggggactactataaattaaaagctgtctcatgtcattagtgtcttgtcaaaagcctcattcattctggtagatttggacttttttaaaatttattttcctgattggttggtgtgtgattttattgtgtagtagtttattttgtgggctgctactttatacagatttacaaagccatggtcatatactactcatgtagccacacagctagctactcagttgagggaaatcatggaagctgtgggtatgtgatgttcttctgatatgtccttgttaaagctgtagttatggctccccggagactgatgggatgctccatgtaggtgtcaaagaaagcagtatgtggctcctgctagcacagaatatgagataagctaccctttgtcccaatcaatgtattctacaccttatagtagattgaacttgagtctaacagtgaaaatggagaaagctgcagagatagacgagaagtgagatttgaaatgcctcaattaccctgtattcattagtagaagtgagtaagcaaagggtattctctaacccaagaaggaaatgcttcccctctaagcaaattttctgccttttttcctgatggtactagatctgctgtcttttctccagctgggattttatacaacaccagccaaacaagtgactcttgttttctttcctcaccctagacttccatgctcattataaagaacaggaactataattgaatgaaatgagttgattctgtgaagagatcattagaatgacactagaagcctttttccatcttgtttattccagaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcgtaagcacatagcatgttcctcagactatttcagtcactgccttttttgtctgtatgtgtgtttccttttcaaaagagtcttagcattcttcttgattcagtcttctcagagagttgattgtcatgttcctcctataccacacttttaaatattctctgaagcaaatgtatactggttgtgtctttgattaactgatttttaaaacataattcaggattgacatatttgcaatttacacagaggcagctctttgaagtagaatgctgacatgttggcacacccaggatgtacaaaagcatcttgtcgatttctgttctgggaaatcctccagagaaaattaccaaactgttacccaattaaacaactcaaaagggcaattatgaggctctcaggattctagagatcagcctgggagggcaggtatggaccatagcacactggagagaagctagatataaaggtgtgtcaggggttctcaagaccactgccaggttcagtgattcactaggaggacttaggactctgcacgcagttataatcagcaaagaggcacatggggcaaagtccaggagagatcaggctcaagctttgcaagggtcctttcccagtggagtcacataggatgcatttaattcctctggcgatgagttctgacaacatctgtgaaatgttgtctgccaaggaagcgtgttagaaactcagctggtcacataccaaatttccagtctctcaggagaaaaagaacccgttcagcataagccatattgtttgtacaaacaatttaggaacaacgagccacttttatcagttctgggaatggtgggaatcctgaaatccaagttgccagatgccacccaagggccaaatttgtaagcaggcatttagaagaatggtagtctcaggcccactatgttaactcttttctgcacaatagatgacctaagtccaataaataactcagtgaacctggttccaaatcccctaagatagacaaatgagtggattttgactacagattggtccacctgcctcctcagctacatttcagagggctacaggaccaatgtaattattttgactggcatggaaaggggtcttctaaaactcaacagatattctgtagaactttggtagcatcttatacatttcagctttgtacacatcttgtacatttctgagtctgctgtgataccctgcttcaagaggctcctgagatagctcaagctaaagtgttgggtagaattgctatcactacttcaggttgttattttttattttgcctttttcactgttttcttttactcacccattaccattgaccccactctctgacatcagaaggcaagactagtaatagagaagcatctaatcccagaaaaatttgtgagaccattaatattaatagtgtattacatgtattgagtagtacaatatggtagctccttggatgtgtcaactaatttaatcctcacaaggccatcagttagacagtgttattttcccagttttacagatgaagaaactgaggcacagagtggttatttagtaaattcttgaggtcaccaaatctctgaggcatggagtgattcaaaaccaggtggcttgacttcagaacccacactcttttatcattatactttaccacttctctcttacggaaggcccagtgttctattttaaggtatcctgttatatagacaaaattctctttggtatttccgctcatgctcactggccctttgccccttttattcacagcgaagtctttgaacatttcttgcaaatagatgtttcacaataattacatttatattttcttatctatagttatgtcaagtcatatcttcttcctgacaagtcccggaacaacaagcgtaagaccaaaatcagaacaggcaccaatccagaattcaatgaaacactaaaggtaaataaatacggtctcatagtaactcatgtggtactgttcacaacttcaatggtttagaagtaactacagagaatattttatttgtgtgtcaaggcttgtatatgttttagaaaattagaatttgaataaattaacataataaccttgacttttctaacatcttttgagaaaaagaaaacactcttactctatttaagtctacgctgctactgaatttgaaccttgagtagagaggatccagccaaactgcatcggtgctgatgcttcttgctaaaaaatcggttttacctttgggcaaacagtgctttttctgacttccgtaaaagaagcttgtcacagttttgacactacttaatgagtcactttgcacgcattcattgttctgctaacatagcataggtctatactgtttgttgttaggatttcagaatttgaccaaatgtaggtatgtggttaatgaatagtggaaatgcagagccagatttgagaaatctcagcaaaagtagcctagataaaatatggcccaatccaggtcaatgatccagaaaatagaaatctctttccaatgcgctttcacataattaaccccttctcttgctatggaacaatctggcctggtaagaaacacccagggaggatggaaagcagaagttattgccaattctatggaaatttatgggcttgtgccccagagtgatggtgtcagagtccactttaggaggaaattggtaaaggcagaaagccacaagcctgcatgtgtcagtgggagcgtgtgtggaagcaggaactaatattaagacagaacaaactgaaaaatgaataaatacaggtagagagtaaattcaatggccataacaggataggaaagatgagcccaaacacagtgagagggtaaatttaggaagcagggagccaaggttaattatgacagtaacagcaaagacaagaataggcactaatccaagatcaggaatcagtcagtgtgaagtgtgtcccagatggtggttgcatagaacaagcagaaggctggagggtgtgtgagcatgtggccctggatgatgttgttacaaaaaacaaaaaaaatgctagcccagcaatatcttctttctgtttaatatacatgtacaccttttcacctctgcacttaggctggactttataaaatttggtgtttgcgagtttctcattgtcaatccttttctggatttggggattctcattatgaataaaataagagagaaggtggagaatgtatatattaaaccttgagcttacaaagtaggtatgaaaaaataattaaggaaaatgaaaaaccaataaaactggaaagaggataagcttcatcacctaacactttttatgcagtatatggagtttatctctacctcagataatttgtttatatatctttcaatgcaaagtctggcacaaaatgagtttatggcatagaacttcaattgtagcagaaacaaagaaaaacaaagagttttctttgtgtttgttttgttcatattactgatgcatatgatctgaaagatgttggaagtaaatttcgacctctcctggaattggatagagccctccttgtggagtgtaatgttgtaaatctcattcgcagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtaggaaatgctctcagattagtcagttatgcaatgagacaagttatgagcgaaattgatgtcacagacctaaagaacttgaagactttcaaatttcaagtgataatctgcaaaaaattagtgcagcaaattttggaataatattataaaaatgttgtaaatccaccgttttggaaattctttgtcaatatagatcatctgtataatgaaagctacataatcatttttttgttaaaaatttttattatttgacagtctcattggataactgaaagcaacacattatatgatcttattagagagtcttcattttcacataggcgaaaccaaattcatacagcatgaacaatccccaaacattacctttatttctcattctccacaatttataccacaaacaggagtgatcttgcctttgcttatatgagggaataaccagtagctaaagtatctgattttcttactttcctacttttgggattcatgacccaggccttgagttacattcagaaaaaaaatcttagagctgataattaaatgccaatactgtatagcatgttctaatctagaccaacagtaccttggattcactttaagtgactggagtctctatgcatttacagtactttttaagccaaaatggaggtgagtaaaggtcacatttatgcagccaaagattattgtttatatacagaaaggcaaaagcacattatgatgaagacagtggactcaaatcaaacttacttggttctatcctggcttcatgactgcccatgtgaccttgggcaaattatttaactttttattccttagtgtcctcagttataatataatcgtgggatgtagcttataggtctgcggtgaagcttgaataaacattctacgcatggccgtcagcattttattgggaacattgtaagctctcaataagtgctagatagtatacgtgttacttgggagtccttgtactgcaacagacagaaactccagctaatactgctcaaaaaatagagggagattattggccagcagtgattaggcatagcttgatccagatgttcaaatcttatcaaagtcttggaatttcttggtctctcttcttatcttcattggcttcattttcaggttccatgcagtgttgccctccctgactagctccaagcatgcctctctaatgactacagtggctgcaagcctttcatctttgcaccacactgttcagaagaggagagttcctcctcctccaacagccaaatcagtgcattgggcctggttctcctaattataattctgtcatttgcctattctaagctattgactgtggccagggaggtgagatgcattagctggcttaagacaatcagaatataccctggttctgaagaagggaacaatagcatccttccagtaaatttcctggaaatagttgaaggactttgctggaatgatatctaagctcccctagacctctcctaggcatcctttgtgcttagaaatcaacattttccacagtaatcacttccacattgtcaatgagtggttcacagtctatcataagagggaagcatctctaagtctttctgagtctactgaaggtagaaaagttctgattgcattcactgtggaataccatgggtcctctgccagatacccttaggttcctaaccatgtcttttaggagatttgccacaacagcctccacctgagactctctttagaagacttccctcgggctactgtagctttttgcctatgtaagcagagagccagaagtcctgggaatttttatacccgctgccacaagacaacccttcatcaataactgataggtgggggagtatgaaggcccacttccttactgaaggtgggaaaaactccaaagtgttacatatactaccacatcaggtggaagctatcttccatggaattatgcccaagattagacttgtccctatagacttgcttcccatacctctttactggtctctctgagagaacttccttaataaatcacttcataagaatcttcaccttagagtctatttctgaagaacccaacagaagttagtgtctctaatctctgccatcttcctctgcccagcttcctctgttctatatagaagaaaagctgaagacacaaacgtgcttagatatcatgtcttccataaatggggaggacaggcataaaggcatgctctatcatgctctatatgctgccttgtgcttcattagtggctcatccccaggctgagctgggctctgtgtggttgattatcagccagctatgtgaagtggcacttcagtttcagtttcctgcctcggtcatttccatgcaattgtcactccagcagctgcagatgtagtatgagcagccttggagacttgacgtttctcatagattatgcagtcgagaaggtgaaacatgagttacacatactgatttccctagtaataggggatcagaattaataatccttaataatttagaaatactgacatacttctgcactaggagttccagaacggcatggtgccttattgcttattgactctattagtgaaggttcctcaatatttatctttgtatgggttagatcctacagtgctaagccagtgaggaggctggtgcagagaaagaactcaagatgccaaacatactgtagtttcacagtataacttccattttacttcatggcatgggattatttattagctgtaaagccttctgaaaggcatgtcaggtagttagacaaggttttatcagtatgaattgcctttcatgccttcccagagtgtactattataaaaacaaggacatctgaaaatcaacagcaagcttacgtggttttccaaggaaacgttctcttattctgccttcaggtagagagtaaatgtatgttcctttggaattatacctagattaaaggctctctctttttttggcagacttttgtctgtaattccttactctgtgttacacctgtaaatgcactgggagtctctttctcactccgatggaaagtggacctctctttttttcagaaagcaggaggtggtgggtgtcatctgcttatttcacatccatgctcagatagtctcagtggttccctactacttttggatatggtttgaataaatactaaccctcaccctggcactcagtgttctgttgaatggcccagcctactgtagcagccaaagatgttagttctctacccatccccgttttcttgcaaacagggctccccacttctttcactcccaccagccaacccctgccaatcattgtaggaggggagccttcgggctgctagagagggcttggtttgcaggccagaaaagccaacatagcctgggtatttaagtctcctgggggtgagcagagccttgatcaatgactggtggattaaggaacgtcaatactcccacgttcttgcctctgattggaacagctctgaagtgtgatctgtcacatctccagagtacccctatgggacttaacaacagttactctccatggaactttgcctgaaatcacatccttaagcctccttcacttttggtcccccttccccagtacccttcctaataaaatactataacttaaataagtgccttagcatcttctgggaaaccctgagttgacaccttattttcatcctccttgctactacctccctgtacacactcccctgatcacatttgacttcctgtcagtccctaaacatattctacacaacccccatcatattttactcatactgctttctcaacctggactaaccttcccaatccatcttcatctgtcatcatgtctcccatcctttaaggaccaggtaagagccacctctttatcccaatctggattaatctttctcttcccatagtagtttctttttacttgtgttggaataactgtcaccatttatcttacattgaactttctgtatagtagaaaccctcttgccccagaaattacaaccagtagtaggtcagttaatagacaaagtcacagaaatcacccacatacaaacacacacaatatatttcttttatttttaattattttgaattgacacataaaaattgtatatatttatcatgtaaaatatggtttctaaatatgtatatattatggaatggctacatcaatctagttaacatatatattacttcacataacatacttttttgtggtcagaacacataaaatttactctcagcaattttcaagaatacaaaacattgttattattaataactatggtcaccatgttataaaatagattcctcaaatttattcctcttatctagctgacattttattttgttaggccagcatctacccagttctccccacccccagcccctgataaccaccactctactctctgcttctattaattcaactattttagattccactattttagatttatatctattttagatataagtgaggtcatgcagtgttcatctttctgtgcctggcttattttaattaacataatatcctccagatttatccatgttgttgcaaatgcaaatgacaagattttattttttaaggctgaatagtattccattgtgtatatataccatattttctttatcacttcatccattgatggacaattaggttgtttctatatgttggctattgtgaatcacgctgcaatgagcatgggagtgtagagatctctttaagatacttatttcaggccgggcgcggtggctcacgcctgtaatcccagcactttgggaggccgaggcgggcggatcacgaggtcaggagatcgagaccatcctgggtaacacagtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagatacttatttcaattcctttggctatatatcttgtagtgggattgctaggtcataaatatggtagttctataacacttactatatttagtctttttgatattagccattctaacaggtatgaggtaatagctcattgcaattttaatttgcatttccctggtgattagcgatgttgagcattttgtcacacacttttggccatttgtatgtcttcttttgagagatgtctgttaagatcctttccccattatttaattggattatttgttttcttactattgaattgcttgagttcctcatgtatcttcgatattaaatgatttaacttaaactatatcagatgtatgatttgcaactattttctctcattctgcagattgtctcttcactctgtcgattgttttctttgctctgcagaagttcagtttgaggcagtcctatttgcctatttttgcttttgtttcctgtgcttttagggtcatattcaaaaaaaaatttcccagacctatgttgtggagcttttcccctatgtttttcctagtcgttttacagtttcaggtctcatgcttaagtctttaatccactttgagttgatttttgtatatggtgtgagacaagggtccaatttcattcttctgcatgtggatattcagttgtcccaatactgtttattaaagagactgtcctttccccattgtgtatttttggcacttttgttgaaaatcaattgaccataaatttatttctggactctctattatgttccattggtgttatgtatctgttcttatgccagtaccatgctgttttgattactatagtttcccaatgcatttcttaaacatttatttttaacttaaaccaaataaatgtacgttcatttgcaagtcttctgatatagaggcaattaattttgtttgaatttcgttcagtaagtaaaattctgccatatattccttgcataaattctcctcctaatgcatcatcatcagaagattctaatttgagcttttctcaaatgaaacaagaacataagaatactttcaaagtaaacaaaatgcaaattcttctaaaaaatgtatgattttttctaacctttgatagattcaagcccacatataatccaatagcaactttgttttcaaatctttagttcttctattcaactgaattgttatagtagcagctgtctttttgcactcatcaatttatgtgactttaaactatataattaaaatcacaaatatgcctggcctaaagagcttaggggactaactaatgcagctgactctcagtgtgcatacaattgaactgatgggagcagatgcatgttctttgcagaaaggattctgctattcacgagggatgaagaacactaattaaactgatgagtcagcagttaactaagtgtgaattaatagatcctgctactgcaaatatgtctactagatagactgaaaactcattgaaagcagggtctgtcttttgtgtccccacagcacttagcaaaatgccttataaaaatgtaagcattccatatgtgttggtagagttgaattgaatatgattggattctgctaactttttctgagtaatagtgggttggataatgacaatggtggtatgccaggagagggtgttgcctaggaatttcctggcaaaatataagtatcaaaaataccctaagacattagacatgtgcaggctgcaatatgactcccctgctttaattttttatatgtgattataatgctacaagcttcatcattattgtgttttcctttcataagacttgaagtctatatttatacggggtctacagtatattttaagctaaaaaccaatggaacattggtaagtcccaataatgcatgtttttgatctctggtagcacactatatattagtatgtgattcctacacatataactttttcctactggcgtattttcatacccgaagatctcactcaaaaagcaaacacagcctgctctggttaactattgctgtatgccaaactaccttaaaccttcggggcttacagcaagaatttattctctctcatgattctgtgggtcgactagactcatctaggtagttctcacttagggtttctggcgccactgcagccagatggttgactgaggctgatgtcatctgaaagctcaactgcattgattgttcgagttggctcacttccatgtcttacacatgatgttgactgctggctagaaactcagctaggcctgccagctggagcacctacatgcggcttctctctgtggctttagcctctcttagtacgagttcccagaggaagcattcggaaatatccattccaagaaagaaaagtagaagctgtcaatcttaagacctggaccccaaaactggcacattgtcacttctgccatattctataatactagtcaaagcaatcacagagcccacacagacccaaagagaggtcacaaataccccatctctcattgatgacggtaccaaaaaagtggtaaccatctttaatctgtcataacatccattataattttctacttatgatagtcacctaaactaaaatttactgagattgtcaaaacaaaaagaagagtccagttacaaggaacctgatctaaaataatcagattaaatattagatggatagtctattttaccatataatctcatttttgccccgggtaagaaggttgaataaaatatttcaagcatttttcccacccttactagtaagttttactaccaccagcaggaaagaaaagggaaagtcaggcaaggattccttttctttgtaacagtctcagtatttttaatttttttttactgtttatttgcttatttatgccaagtcttgaacagtctctggcttggctatgaatgagctaggtttcgggactctcattctgccctctctgagagagcagttctctgcttttgactcagaagtcagatccctaaaggaaaagcctgacaaagtatactgcctttcctgctctacctgtgaaagaactcaaagttcagttgactcaatggcaagtgggagacctatagaatagaggttctgggtgcacgtgcacattgactttctttaatttaaactttatattttgagatgattataaatctacatgcagttacaagaaataatatgaagagatcctatgtacccaatacttgattttccccaatggtaacctatagcaaagatgtactataatatcaaaccaggttttgcttatttttttagaggcagggcctcactctgtcatccaggctggagtactgtggcacaatcatagctcattataatctcaaatttctgggctcaagctatcctcccacctcagcctcccaagtagctgggactacaggtgcatgccaccatgcccagctaatatatatatatatatatatgtacgcatatacatatatatatatatatatatgtacgcatatacatatatatgttgagagatagggtctcactgtgttgcccaggctggtctcaaactcctgggctcaagcaatcctcccacctaggcctcccaaaatgctgggattacaggcatgagccactacacccagccacaaccaagatattgccattgatatgattcaccaattttattcagaattcccagtttggtactcatttgtgtgtgtgtgtgtgcacatgtgtgtgtatatttcatcctatgcaattttatcacctttataggtttgtgtatctactaccacagtcaaggtacagaacagttctaataccacatgtccctcaggttgaccttttataaccacatctaactccctcccactactcacatccctaacttctagcaaccactaatctgttctccatctctataattttgtcatttcaagaatgttacataaatgaaatcataaagtatatgtcattttaagactggcttttttcactcagtataattctctagagattcaacttgttgcatttatcaatagtctattccatttttattaatggatagtattccatcgtatgaatgtaccacagtttgtttaaccattcacctgttgaaggaaatccatgtggtttccagtttttactattacaaataaagctgatacaaatattcctatacaagttttgtgtggatataatgttttcatttctctgggataaatgaccaagagtgcaatttctggttggatggtagttgcatgtttagtcttacaaacagtcttacaaactgttttccagagtgactccaccattctacattcccaccaacaatgtttgagtgaaccactttctccatgttgaattttgattatatgaattaccaacattgcttttaacagttgatggctggcagccccatgtgaatcaagcattattgcctacttttccattcttgatcacttgggaaagacttaaaagacatcaaagatgacagggagaagtaatttctggaggtattttcagtggcatttttattcctgcttcttcatatcccaaactatatatgtaaactcagtgataggtccagtcatcaatgcatcacaggtgctcaatatctattgactggccaaatataagttatatgtcttctttcaaatttcttttacttaaatgttaaaagttatatgcaaatgccttcatagagttttccagcctttgttttctcttacctcagtcatctcttaaaccagtgagagcgaacagagttgaaatgagaatggattgtcacatttatgccactaagtaaatattgcacattcaaatgtggactacaatactaagccaatcatccatactctttcaacttacttgtttctccttggccaggtggagtttgctcctgatattggccttcaatacaaaggagagctgacagttgttttacgttacattcccccagaagagaacctgatgcttccaccagaacaactccaaggtagagtaaaaatcaatgactttgatcaatgacattctgtttctagaagtgtggtagtgggactcagggattggttgcattatatttctttcatattacacaaacaaaacataaagggtttggtgtcactgtcttttggggagagttgagatgtgtataccgtatatatagaagaatgcaggactcttacaaggaatccttgtaagattcatacttagaaaccagccttggtggtcagttttgttttatgtcccaaagatataggatcttcccccagggttgggggaaggcaggctgctggaggcaagtataggaaactgctccatggatttatgacattcacagctattcagggagtcttgaggaagaagttgatctagaacacaggatttaaaggaaaaaatcagatggaatcaatttataaatctctcttcccctttgtattaagctgtttttgcattgctataagaaataccaagactaggtaatgtataaagaaaagaggtttaatttgctcatggttctgcaggctatgtaggaagcataaaacaggcatctgtgtctgaggaggcctcaggaagcttacaattatggcagaaggtgaaggtggagcaggtgtctcacatgacaggagcaggaacaagagaaagagagaaggtgccacatacttttaaacaaccagctctcacaggaattcactcactatcatgaggacagcaccaaggggacggtgcaaaaccactcatgagaaatccaccccatgatccaatcacctcgcaccaggccccacctccaatagtggggattacatttcaacatgggatttgggtgaggataacatccaaactatcttgcccttcttttaccatcaattcttgcaggcagcctcctctgtcctcccattcactattactcttttcagtgtgaccctgtgcaagtaactcactatcacctgacctcaatttcctcacttcaaagggctgttgtgaagaataaacaggttcatatatgtaaggtgcttaaaacaatactaaataaaggtgctggttgtgatactggtttatatcattcatgttgaatgtatttcataagaaaagaaaagtgaggtggaaaagagatttctctcaccctaaaacgtaactgtgtttgggctgtagcctctagagctggctctgactaaaactgactatttgtaagactaaaatatcaaagggagttattgaattttctctttttgagttttggtgcatgtatattgtcttcatcatagttatttctcactaagagcaggaatggtgctccgggaaactcttaggcattccatgcctttataccctgtgaaaagatatgctttgtaagggagtgtttaaagttttaaatttatttcttcatttgtttcaacaaatacaaatgaaagacctatctggaaggaatccaatgggggcaaaaatgtttaaatgaataaaaatatacaataatgtaaaggcccaaattagtcagcaaatgaaatatatgtttgtagatgatctttgtaaattttgaaatggaactcatgatttatctatttttttttctctttctccaccattccctcattttggtggctgacacaggaaataagacttttaaaaagggaaagaagaaggagtcacctgtaatctctggaggaatactagaagtgttcatcaaagaggcaaagaatttgacagcagtgaagtcaggaggcacttctgatagctttgtgaaggggtaactttgttttagctctttttggatgatacttaataggagatgaaaggatctgtgatccacaagccactggtggctgtgagccttccgtgttctgtttactagaagtgtatgggtgagaactacccttacatgctggctcttacatctaaaataacacaagtgttgagggaactgctgattctagctgtcactctgtttccaacatatttcaggaattcccatcactcttactctcaagacagtcaacttttttctgtaagattcatttatcgaaagtggacaaaagtatgatttcctatgtataatgtatttatattgttctttattatcattttgtcctggcaatatgcaacaatcaccaaaatatcagatccttgatatttttctctcttgggggaaattgtaaaaagtagagatgtcagagcatccttgctggacttattcactgtcgagtgctttggagaggctccaagaccacctgctaggcatttgtgcccaagttgtggagcaaagggcagcttcctgagggaatgcagccttaaaatggatacttttgcctaactctaggcaactcaaacatcaaatcccttttgattcctgactactggatatttttctcttggaaattgagaaactaagactgcaaggttatttttcagtcattcaaacaaacacaaaatgcacatgtgccaagcaccaggtgctatgctttcaaaaataaataacatattatccctgccctcatggaactccgtaaagcacataaggtaaaacaaattcccatgatgccagaccatgaggttcattctttgagtcggatggcaatattgttcctcttcacatgctgtattggaaaagagtattttttcctacaaggaaatgggttgagctcactctcacatgttatttgttgttgttgtttgtttttgtttttgttttgagacagagtttcactctgttgcccaggctggagtgcagtggtgccatctcggctcactgcaacctccgcttcccaggttcaagtgattctcatatctcagtctcctgagtagctgggattacaggtatttttatttttatttttatttttagtagagacagggtttcaccacattggccaggctggtcttgaactcctgacctcaagtgatctgcctgcctcggcctcccaaagtgctgggattacaggcatgagccaccgtgcctggccacatgttctaactttggtaaagctagtagtggggagaagcagttctggggcctccccattggtgagtgtgtatgcctgaatcctggcacatcttcccttcactcttccttgcagtagatttaagcatagaagaaatgctttctttggatactgcagttacaatttgtgtcattagccctaccatccagtttaagcttctgctgctggaatgaggagatgactcccaacccgtggccacattgtgaccttgcaacggtacttgacatcttctggagcagtattcactttatcttgtggaaaatgtataaagcagaaataataaaagacagtatttttgttctagaaagaaaaacaaaagccaataactttccggtaaattctgtctataataatacttaaatattaggctgattctaaaaagacatgagatttttttaaaagacagtgagggagcaagaatagaccctctgtaaagtttaataatataaaatatatccattaacattaggtcggtctgtgagccaaaagaacagtggcttaaacaagacaagttttttttctctcttacatgtaaacaaagactgaaggtaaggtccccagtgcaggtatggaagcatcatgattatcagggacccaggatttttccatctcgttatggtatccacctaatgggttaggatagctgctcctgtttcagctatcccacacaaattccagctgacaggacactttccagatgtaagaagtagttttatcagcactacttcttatatcccattggccagaactcagtcacatggctattccagctgcaagggaggttgggaaatgtagtctttattctgggcaacactgtgctcaaataaaaacacagttttttagaggaatataaggagagaatggatattaggagataataagcagtctttgcttggtacatgaaattaaatcttaagtgacttaatgtatcttctttattgtaaagtcatttgcttgtagcacttttcgtttttgttccatgtactaattccatatgtacatatgtcttcttttctaaagtatgctccctgaagggggaaaacagccatttttatcacatacctagagcctcatacagtgttttgaccatagtcgagaaaacctaggatacaggcgttttatttgaagacaaatttcaggaaacaccagtgaggaagtggagaaaatgaaacaaggaagaaagagaagttgattaaaacatatgttaatgggcaggttaccactgtgggcaactggagcatgattccactagggaagcagtgaggaactctgtggaatataccttaggattgtcactttgagggacagggaagatggggaaattatccaccaatttctcaaactcatcagttaaaagttgccccaggggtattaaattccaagtaatcccagagtttcctacacataagctgagccagctaacacaatatcagataaattccttaattagaggaatttattccttgtatcaagagacacaagcacttgaggtgggaagctgaaagtatatcaggaacttcccatcctggctgcaagtcagctccaaggaggccaaaaagatttgaagcaaggcattcaatagtgtctattacaggaggtattttcttttcaagatggaaggaaggacctaaataagattagaaaggagagtgagggcattttactaatgtcccactgggaagaaataataagtcagttcactatataaatccagatttaagcatatagaagcctgggaaggaaaatcaaatagacacatcacacttgtgtacacgctgacattttctgtctgctgtcttattgatgatttgattgttttttctcatgcagctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgagggatttggggacccacagggatggtctgtgactaggcccaggtgggggcgctattcttgcagatgtgatgtgcagtggatgtatatatatagtttcagctaaatcctgaaattaccacaaatacttcattcctttagctaaggatctattcattgttaaaatacaaatataactacagtaactttgtatccttaggctagaagattggaagatatcatatttatattcaatcctttcatagactagcatttacaccttagtctaagtgaattgtaagtactttcttgggccttgcttcatattttgctcaggggatgattaccaagacagcataggcttctgatgggaggagagcgactttcaagaccaacattacttcatcatcttctcagttctgtccagcacttgcagctattattcatactggttgaattgaaaggaaatcattttttcataaaaataacaccagtattgttaaaaacagatcaaggaaacccaccactggtgccacaagacgcaactgtaacagggtgaattggaagagggattacagtagtagagcacgtgcattcccctaactctcattatcccatagcctaagccagacatagatgagaccatcagcatacaccatggtaaacatttctgttgaggaaggtcctatcactatgataattacttatttatagattaaggggagccaaaaatatctataccactaaaaggaaaactccccaggtcagaaaagtgcccttgttagaaaaagagagccaaattcatcccattcttctgtcatgttagcacagtccagatgaaccagctctctgctaaagtagggaggaagtgagtcaccagggccaccccgatttgcctcatatggcctaggcattagagaatagtgcaggctgaaatgattgattgattcaattctaacaccactcactatatatactaagtgagaacaagccagtaaaaggtactctggtgaaaaggcctgctcagaagttgatagataccttgcaggagagcaaagcatttcatgtgtgacataaaattttcccgtttcgcctcttcaggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactcattctgtcttcagttacatttttaggggaggtaagagggtggtgatggtgaagtctggaaacatctctggtatagacacaacgaagtggatttattcattaataataaatatgaaaaaataataaattttaaaatttataacttgaactcaagaagagcatgaactttatgtgttcagatctttgccacacgtagagcaactctctgtatcatggtttcataaaatccaacatctaactaggtattcccataatgcaaaacttaagtatgcaaaaatccatcagaaacctattggtgttgctcttggaaataaaaggcaaaagtatggtctagaactacaaatagtatttttaaatataggtaatgcatgtgaatagcacagaattcaaatagttcaaaattgtgaaaagttaagtcttcctctctcctcttccatatcagaaaatattgactgtctcattcttctttatggctacaagatattaaattatagggatgtatcaaatttatttaaccagtccaacccactaccacattaaatatggttaaccaagctatctatatttaatggcttttctaagcaaacttttccttcaaagaataaacactttgaaattcaaaatgaggtataaatcttacccaaccattccacttctgagtatttttcttacagaggtaagtgcatatatgagaaatgagtacatacaaggatatttattgaaagagattggaaacaatccaaaagcccatcaataaaggccttgtataatatcacatgaccctgattttctgcttcacaagtcactgcttcatctttgtctttactcattctctacaaaactattaaaaattggattattcagtgctcagttcttttctcctcactttatacagccttctaggcattatcatgtactgtactctcaaggtttcatacacttttcacttccaactcacatctctaacccagacccttcctgtcagccccagacccagatctaactgcccatatgacatctccaccaggatacttcatattttcaacatattaaaaactgtacccttcgtttcagtctccctcgcacccatgtcttcctgcaccagcgtgccctatctctgtacctggtaccttcatccacccagtaacagtaaccagacacctggtattgatctttggtttctgcctctttcttatcctgaggcaaaaatcaatcaggaaatcatattgagtctgcctcctaaatatctctagagcctgtccaattctcactgtctccacggcaccatcctagtccaagccactatcacccttctccaagattatcgcagcagtctcctagctgccgtctatgccaccaattttgtcctccctcaatccattcctcttactgtggccagagtgatttgtctcagcatgttattttaaaatgttcaaatatacagaaaagttgaaactttatagtgaacactcttatatccaccacccaaattcagctctgccattcacatttgactatacttgcttaccattattgatctatctgtccatccccagagcaatctgtaaaaccctcatggcttcccattgtcttgagaataaaatataaattcctgctcatggccctgcacaagatggtcactgccagtttctcccagaccatgactcccctccccttctcttcagccacagaattcatttttctacttatcaattgtgccaggctctatcccacctcatggcctttgccaggagtcttcttggtccatcttttcttcagcttgattcccattagtcatccaggtctaaaatgttacctcctcagggaaaccctccctgatcactctctactgaactaggtcacggcagcctgcctctatttccccttcagtgcacacatcacaattataataaattattaacgtaatgagtccttgaatgtctgtgtctgtttcctccctgtcatgtccctagaatgtaagattcagaagggcagagacaatatttatattttttacagccataatcccagtccttagctcacagtaggtaatcaaaaaatatttgtggaacaagcaaaaacaaactaatgtaacatcatagaatattagactgtaggcatctttagaaaccaccatttctaactcccaattaacagataaggaaactggggcccacatagatcaagaaaaatgtctgaattcgtttactgattggtcttttaaaagccaccttgctatagtcaccatgctgtgcaatgacacagcataatgattatacttaaaaataatgtatatttcaaaacagctaaaagagaggatttcaaatgttctcatcacaaagaaatgataaatatttgaggtgatggatataccaattagcttggtttgctcattccacagtgtatatgtgtatcaaaacaccacattgtactccataaatatatacaattattatttatcaactaaaaataaaattaatttttataaaagcaaccttccaacaagtactgtagatacaaccctagactgctgggcccagcttgtctcagcatagatctaagcacaaagtatgcttccggccccgcatgtcagcttatcagaagaagaggccacagccttgcatggaacgtcctactccttctttgaagatctcaactctcatttttccctcagataaatcaagttgaaaagggacatggacaaatccaaaaggctgattttatccatgcatacataaataacacatacaggatgtggtagattaattctgttaatcagctctcctttcatttatgttgttattgtcgctggactcatcaggatgtagatttttcaggtcacgaaaacaccattaaaaaagatattttgaagtaacttcatactctcggcctctttttccttaagaaatgttcacaaatgtatagctaataatcattaagtacttaggtaattaatgaatgaattgagcccacctgattcagtcatattagtgtcatcactacctactactccaaggtttaactttttttttttgagaccgagcctcactctgttgcccaggctggagtgcagtggcatgatctcggctcactgcaagctccacctcccgggttcacaccattctcctgcctcagcctcccgagtagctgggactacaggcgcccaccaccacgaccggctaattaatttttttgtatttttagtagagacggggtttcaccgtgttagccaggatgatctcgatctcctgacctcgtgattcgcccgtctcggcctcccaaagtgctgggattacaggcatgagccaccgcgcccagcccaaggtttacctttggtgagggaggagaaagccatggaagtaattagagtaaaccccacctttagaagcaaagtgtaatgaaatatcaagtcctagaagcatctgaaagtgagaactagtggcattttgggctgtgatcaatgtttgtttttctcccatgtatacatttcacattaaagtgaacattgtctctagaagttaccagaagggttttactcctacgatagtgtcatgtatgacctctgaaattgtggaaaaataggaggggaatgttcatacaggcaaaagtacaacaaaaattagatttggaaaggtttgaacaatagccaggaaaattgcactgcatcaaggattccaaaggactatctgaatcatctggagaatgaattgaatacatttattccagagcattgctccaagcctactaaacaaaatctccagcaatcccaatcattttaatcaagcttcttgggtgaatctaatacaaatggatcagagtttgagaaacactgcattagaggacaaattatatcaactctattcttcaaaccaactctacatcatgatggcttcttgaatttgatcttgaaatagtcgatcttctgtatacccagagatcattaattgcaaggcaaccatgaaggggtggaaagagtctaaccttcaactcagagaatactagttcaagtcttgaattgggtacttaccaaccatgagacttcagtcaagttaattactctttataggccatggtctatttgcctgtaaaattggaataaataggctactttggagtaactgaagatatcaaataaggtaatatatgtaaatatgctttgcaaattctaatccattgttttaaaaaggtcattattggtgagctagttctattactctgtggttcataatttcttatgcccctcttttcctacatgctgggttaggtcttaagcattctatgtacaattaagtgatctccagtgtttaggtgtagcaaacattaaaaaacctgtattttatgctaggttaccccttgtgggtgatagtaatatatttattttagactgaaatttcacacttcattggattagataataaatattacagaaaatgtttaatatcatggggagaaaaattggtcagtttcttggtccacagattatggaacctgcaagcaaaccatctttcctcccctttcttcaacactctcttccagtgtaatgaccatcgctttctatggcccattccctataccctatgtcaggaagataaaacctgctagcctcacaataatgttgtgtagagtcatgttctttatgtacagaaggaaatttaccatgctgtcaaaacaatttccatagaaatgcaaactgctgttgtcgctatgagtaatcaattgtacctcatttacctcactagaatttatccaaattttctgggggagggtttcttttatacttggaaaactaaagtagaatatatggttagtattgcctataaatgccaaaacactcatatggggtagtagatcatacttttctctcaagtattttgacacaaataaagatttgtctctgatttcctttttctctgaaggagacagaaattaatacagcacataaatcagatattttattacagtaattgaagcaaaagtttaaataattggaattttctaaaagatgtcttcttataggagggcaaagaactagatagatatttaaatctaaatattttatttttacctctttttttctttctttttattattattattattatactttattgtgagatacatttactttggggaaggattctgatttctctttccaaacattttttctacttagtcaatagttcattttgtctttacaaacttgaagctcgtttgtgcaaatccacaggaatccataagtcccaataagtagacttatttttaaacctttctcctttggaaacaaggaaggaagccattccatcacaaagcagtcatggcaatcaattcaaggttgaacccgtagttgaaatgattggggattgggtatgtatatttgtttccatcctttcttagtatttattattcataaatggacattttaaaagagagatcattggctttcagttgatttgaagaaagagatatctggacttttccttagccttgatttttgagcttccccgccacctccattaatttgtcttccataatacctaaatatcttcttacattgtccctctggctgatggcatgcacaccagaatcttaagagatgtccttcatgcttttttccacatgggcttatggaaatattattcttcatttttagctctttcctgtcacctcagagcccagttctgttagagtcacttgcttgcaaggcatctgaatgcacagagccaggctgaggagtgggctgctggggagcttcccagggtgccaaattataaagggtgctaaacatccctgaaaatgtaatgaggtggagagctcctctcaggaagaatatggtattagcaggaagaaataatgtctgcttgaatagatagatggggtgaggagctcatgcatgaagagcaatttatggctgataaattgcctcctaagacagatctgtttaggtgtggggcctttgttttgctgaatggggcatgcaaccttggacaacacaggaattgggaaggacatagggaaaagggacatttgccttcactggggacttctttcaaatctcttccaccaggcaggcccacctaaaaatatatgttgtacaaattcttacagagcatctgagaattgcacgacataatcagcccaagtattggcccagctctttgaatgcaccaggtctccattcctggattgaacataatagtcatgaggagactttttctctgggacctgaagataagttcagaggtttagtgggctggagaaggaagacacattttcaatatctaagaacatctaaaatcactgggtcgctgaaacattggaatgggggctcttctttaaaaggaataagggataattttccaaactgtgccatagggtgggtcacctacatgtgagtatgttcatttctgctttgtcatggcattcacctgcttcagctgccaatttactctcctacactcttgttctgataggacgttggtctcttttctttgtttgtttttagttaatagagtttatttctcagagcagtttaggtttacagaaaagttgagcagaaagtataagagttcccacatactaccttccctctgagtttctcctattagtaacatattgcattgatgtggtacatttgttacaattgatgagccatattgatacattattattaactaaataccatactttacattaggattcattctttgtattttagttctatttgttttgacaaatttataatatcatatatgcacaattacattgtaacacagagtagtttcactgcccaaaacatctcctgtgatttaaaccatggcaaacactaatctttttactgtctccatagttttgccttttttcagaatatcatatagttagaattatgcaatgtgtaacctttttggatttgcttcttttacttttcaatatggcatttaagtttcctccatctcttgttgtggcttgatagttcatttcttttttattgtggtaagaagacttaatgtgaaatctactctcttaaattttaagtgtaaaatatagtatttttatttgtttttaaatagagaaaaagacagaagaactctgaggaaacagtaacaatttttttaattgtttatttttcttttatttatttatttatttatttatcctgctagatttttttgttattattggccacaaataactgttcctgtgtgcttgccttgccatatttactaactgcttgtcttaccatgctactaattgcaaaattagtagtaacacttaaatacttaacatgcctacttctaagcttctgtatgtaacatgcatcccagacaaaagctttgtgccaccctgaacttgctgcaaattgggattttttcattaaatttactttcctaatatctctaacatgttctgagttattcctgagttcttttttaacttttattttacattcaggggtacacgtgaaggtttgttatataggtaaattgcatgccacagggttggtgtacagattattttgtcatcccagtaataagcatagtatttgacacgtggttttcgatcctctctcttctcccaccctccaccctcaagtaggccctggtgtctgttgttcctttctttgtgtccatgtgcactcaatgtttagctctcatttataagtgagaacatatggtatttggttttcttattcctgggttcttgaagatggattatatgtcacctatccctcgtgtctttatatttatttgtctttggaggaaagcacatttgctgaattgacacacagattggatgggtgtctggttgctgtttttaaaaatagaatgatgttgaacaactcttcttggtgctcagctattgaatctgccttcccatttcggtttttgctcacttatcttcctgtaagtctaaactctgaaacaattactccctttgccctcccctcaataaatcaagggaagggatcagaaatgacatttattgagcatctactatgtgtcaagtactttatgaattgttacgtaatttaaggctgttttttaaaaagacctaagaggctcatagaggttaagtaacttgcccaagttcaaagatagtatgtaatacagcctcacccaacatggagcttcccagttcagatcccaaagcccaatttctttgcactacactaaactgcaacccaactagaaaccttgtgtttgtcatgagctggagacttgcctcttacagtgggattcatgaaccaacagcattaccaaaatctgggagcttgttggaaatgcacaatgtggggccccagcccacacccaccgaatcacaatgctcattataataagatccttagttgatttgcaagaataatgaactgtggaatgcattggtgtacagaaaatggcagaattgatattgacacttaagactatcgcctgtcagttgtagttgatgccaacattgtcctaagatccttccatttgccagtcttttctttgagtcctttttattccttgatttttttttctcggcatacacacatgcttgattactaacatctttgtgtgtgtgtgtgtgtgtgtgtgtgtgtgtgtgtgtgtgtgtgtgtgtgttttctcctgtggttatcctgatgacatccctcagccaggtaatttgactttatttcagagtccttgaaatgaaagacctaaatattttttattctagatgattctgataacctgctaaatagaatgaggaccaactgactttggacacagtctcccctaaacttgaggaaatagtccctgaaagctttattccatagtactaatcaaacatcttctagctggtatcttctattttcaatcaagactcaatatttgtgttgctgctgatgacgaactgtagagaaaagcatttggataccaagttggcttaagtcagtgataaatgtgaggcttaacccaaaagtacattttggttaacccaaacttgaaagaggatgatgtattataaagaacactgagttgatagttaagaaacctagctccttctccaagctgtgctacttgctgtggcttttgagcaagacaagttctctcactgaacctcagttttctcatctataaaatgggagacttgaactaagtgatattcaaagtctgctcaagctctaaagtcctatgacaacttacatgtgctagaattaatttactctttgacaccattgattgtaagaggcagccttactttacataccacaaaggaagaaacaaatgttgtcaattataattttttaagatgttgctctggatattctacatctgttcctgcatattttctctttgctcttttcacactgttttatgccctaagaggtgaaccttaatgatttgcttcaatgtgactctcttaccttctggattttggttgggtttggacaaagaaagccagcagtaggagattgaatggtgtgaggaaagtgagactggtatagttacaagcctggctccctcctgctgggtcaccaagtgatagtggctacctctattcagggctatagttctttttaggttaccttctcctgcagctagagccacagagccactcctgccctccaatctttcaggcctactagtggtaaaggctcctagctgttgctagtatcaccatcccttgttgttttcccttgaccctgactgcacctttataaataatccctctactaatctttcctcagtgttgcagccacagtttcagtgttccatctgtttcctgctgagaccctaattgatacagtaattgatattaggcttgttctttaggaagcagcctctcaaaatagaattccaagattgtattgctcacatatttgagaagcattcccagcacttggcacattaatatgtgcatagtacatgttaacgtctttgaataaaaaacaaaccaaaaaaatgtcttccaatcgtagtgcctctgttcactggaagaaatataaggtagccaaaaatcaagacagtttttcttatcacttttatttctaagatattatttagtctaggctcagagtctataactcaccaatcctttagcaaaactgctaatcagaattgcgtgggctctcgactagtaatgactgagactactcagtctggaataaaagctactgtgcctttgaaaaactccattgcattttctttcctaatttctaatttactaattggtctctatagagacaaaggaacaagtgtctcacctctggccctcctctagggaaatgctactcaaggtgctggcccatgataagatagggagcttgcatcagaatgtaaatcagtgtgtggcttccttcatggaaagttttgcaatcaaaaacatcagctgaactaaataacaaatttattgacactgttgatttccagtcttgggcaaactccttatctccttgtaaaccagtaataaatggtgcagggaccagcaactagtacaaggaccacattctgaggagcattgctctagagggtcttggaactcagtcccttcacaaagttcatatatttgtgctatattgctgccacttgttgagaaataaaagtatttcttctctttctggtttttcaagagagagagaagtaactcctcttttgaagcctggaagttcatgcttagtctcagaaggcatcagaaatccacttatcctgcccaagagtcaaacgtaatttcatgaaactaagcgacacattggaaggtactcaagagagaaagattcagatttgatctgtgaccaaacaatggcatttcagttccatttgaagtcaatttgttagtctcacagcactgctgcctaagcacagcaccatccttcacagaaacttgttctgatgtagagagagacaatacaacatttcaaacacgatgcagagaaattaaattttcttcaagctccaatgcagccatagagcaaacagaaaaacaaatccttaagctgttgagcatcttcagaaatgacaccatagtaacagaaatgcatctgtaccctgcacattcattagtaaaattgattctgatgaacaaagctaggtgctttgcaacattcctgtggctttgtcctaaggagaaacaagtgccatattttaaatgagttaaacataagtttaactttgtaatgcaaacactaaaaaccttggccaaaggcagagaagcaataacaagtgtttctccaaagggggaggtgtattcccatcattggttataactgccatctttctcacctcgaccaaaacggtggttctcacccttggcttcacatgagaatccccttggaagcttttaaaatccctcaagtcctgtctgcacctagaccagttatatcgtaatctctgggtgtggcaccaaatcatcagtattttttaaagctccccgagtaatttgaatgcatatccaaggttaaggcataaagtgtattgagagggctggtaggccaaggttgtcgtgcttgcagtcttgctgacaaagacatcccccttactgcagcaacccttaggacacagctatacaagaagccctcagtgtcccttcttcagttactgtaagtcccagctttaaagctgttaacaagcaagtaaagctgagaggagatgaaatatttgtgacttcttgtgaagattaaatgagatcatttgaacgcagtgttacagtttagatttttttaaatttaattttaagctcttggatacatgtgcagcatgtgcaggtttgttacataggtaaacgtgtgccatgatggtttgctgcacctatcaacccgtcacctaggtattaagccccgcatgcattagctattatcctgatgctctccctccctcacagtttagagtcttgatgaaccaaaagggtctgctcatccctgctcttcatttctgattaatttagctaaggatacagaacctaccaaaagaaagatagctgcaaagaacaggagcagatgcagcacatgtggagaaatgttcccttaagtgtggggtctctacaaggcacacagctattaggaacagtccccacaagacctaccagagttaagaaagatgccaaattttgggttttttccactcctttctattccagattccatcacaattccagaattatattaacaaacggggcttttcagtttaaggcagtacaatgtttggtctttggactcctgggtgtcctaaaacttcttcaaggggttagcaaggacaaaactatcttccttacttgctcttttcactgtgcaaaactgtagcactatggcaggaatcaaggcagtgcatatttttatcttcatgctttcatagtaagaaaagtaaaataccagttttatttaagaatatccctgatgaagcagtaaaaaatagtcttattaaatcttgaccctaaatacatatgttttaaatattttctgtgcataccaaagtatgatgcattttcagcattctttttattttaaagaacaaataacgggttattcaagcttgagaatttggcagacattttttcaaaaacgaacaaagtgagcctgtcacttcagggaaaacaattggcagtacttgttgccaatgataacattaaagctttgaagcaaaaattagaatttttgaaaacttgtatctaccattgtgactgtgacagcttcctaatacttatacacttttctgataagattggtgatgacattaactaatgtgatattctaatattgtgtaacaaaatttatcaatctttggaagagctacttgattcagtgaaccagtgttttctaaatgatggatgcatgagttacaaaattgtgcatagataaaagatacattcaaagcacaagatagaccagtggattttaatgcaacagagtacaaagagttttcatatcaccattaatctttaaggaactaccacttgttgacttttggtgaagtgtcaaaaaaatattcacagttatctaaataggctattaaaatactcctcccttttccaaatacatatatgtgcgtgtgtgtatatatgtgtgtgtgtgtgtgtgtgtgtgtgtatctgtgaagccagattttcttcttatatttcaatcaaaataacatattgcaagagactgaataggaaagcatatatgagaaactagctatcttctattatgccagacttgaagagacttgcaaaaatgtaaaataatgctgctcatcttactttttggttttgcaaaacatacttagattttctcaaaaatatgttatctacatcatcatgcaataaatttattttttgaaatgcatcgaaatataatttttaaaatttctctgttttgatttctaacctggtaaatattgagagatgtaactcacacaaagaaaagtactttggaatccttcaaaggtttgagaactgctggtttaaggaaatttttatagacctaggctgttcacatttttgtttttgcagacagttaaattactaattcacccagcttggtgttgtggaagcttgattttaggctttgttaaggaggtctactttgatttaactgaatcctgaatcttgttctttacttttgaagagtagtcctgaattttcagtggaagctcaacctgttcactgagctcctttaacttgaaaggatttgacctccaaactatctctccagcacagatcagctgctgagatcactgctcagctcaggtctttcccttcagctattttgttttcctcctggacttctcgtagcctcactctgtgcatgcacagctcaggggtcagttaaagatttaagggcaatttatatgcacatttgggttccccctcccaaatcccacccactggctttctcctttcacatatctcctccatttccacactctctggtcatcctgccgtcatcctctgaatcctcagcccagtaagagtacagccttctgcttgagttccacatccagtacactagcaaatggaaaagtcctcaagggaaaagccaaccaaatgtgcatgttacccaatgtgcttacattctttcaaggtcatagttatttcagactctgcctgcttttggttgagtgccaatgagttccagtaacttctctttctttattttgtccaaagttataattgttatcagcagggaggttagtatgatatggggtagtctgccattaaatgaaatttaattcctgtgtcttcccattttgaactaagattagcaaggccaagttctcatctgtggggtgacagcagagccataccagacccttgaacaatatatcctccttcatctgtgcagtgttctataaaatctatttccccacaatccactcagcaagtctggtttaatatcctcttgccggggtggttctgatgttgggccaaaggccatcataacatatccaattgtctcacaatctttttttttttttttttagacagggtctcattctgtcacccaagctggaatgcagtgtcgtggtcacagctcattgcagcctcagcctcccaggctcgagtgatcctctcacctcagccttccaagtatctgggaccacaggtgtatgcctccacacccagataatttgtaaacattttttatagagacagagtcctgctatgttggcccaggctggtcttgatttcctgggctcaagcaatcctctcaccttgacctccgaaagtgctgtgattacaggtgtgagccaccacacctggccaattgtcttacaatctaataaaatcagtgtgttgaagacatatctgcactcccatgtttattgtggcattattcacaatagccaagataaggaatcaaactaagagtccatcaaaagatgaaagaatatttttaaaaatattacctcggttacctctgaaaatattcttgccttttgacaacagcagcaggctctttttgaatttccctgcccacacgtagagccaaatactctctaggaagtcctgtctccttgtggagttgatgatgattcctgtgtaacctgtgctagatacctcaaggcaggaagaaccaggcccagcctccaccataaggtcagttctggtcatggtagggggctggacctgactcttcctgtctcggttgtctaagataggttacacaggaatcacaaggaatgtcagttctggcactaaaacattgtcctctgaaaatggaaacctcaaagcctatcaagttcatccatgtctctgatgtctataatcctccagttacaggcatgagctgtctccctcactggtcttgttgttgtctcattctcatactgctctgagtgtccccttgcccaactctcttccagactttgatgcctctggactattgccgtacacacacacacacacacacacacacacacacacacacacacacatttcatagtaaagtgaccttttgccttagtccacttgtgttgctataaaggaatagctgaggctgggtaatttataaagaaaagaggtttacgtttacttggttcatggttctgcaggctgtacaagaagcatagagccagcatctgcttctgatgagggcctcatactgcttccacttgtggaggaaggtgaaggggacctggtatgtacagagaacacatggcaagacaggaaacaagggagaggggagtgcagttggaggctctttttgatgaccagttctcaggagaattctcacaggaactaacagaggaacaactcactccttactgccaggatggcaccaagccattcaggagggatgtgtccctatgacccaaacatctcgcattagaccccactttcaacactgggaatcaaatttcaacatgagacttagaggagtcatatatccaaaccatagcaccttcctatagctttagtatcttttcaaaatattcttgagtaaattcttgttttcctctttgtcgcttttcttacagcaggttgctctttcatactttaatatcacttggttgagaggtaatgtcaacatctgctcaattccccacagctccttcttaattgatcattctttcctaatctgagcaaaagaccttctctgagaatcctgccatctaccatatcactttccatcatgctctccttacagtcacctatctatacacagttatctcctccactctatatatccttggaatttgactctcactcatctcctttgccttaactcctgccagtatccacatcacccatttggataatttattcaacttcctaacatcacaatttcaatgatattttcttcatctcttccaaatctctcatatctttatactgattatattcactcttaaaccacattaggatcattagcctttccctatattctttgaataggtcagtgccactactgttttttgtttttgtttttgagatggagtctcgctctgtcgcccaggctggagtgcagtgccgcgatcttggctcactgcaagctccacctcccgggttcacgccattctcctgcctcagcctcccgagtttctttttggactaactcttgtccttgtgtgtaatcacacaatccattttctcaatactacaaccaactccctccccttgtcctgccaccatacctttgtcacaaccatctacccccagattagtctttcagtatgccttctctcttcctcaacctgtgtgactaagcattgctgaagaaaaatggtcaattgtactgaatgattttatcatggcttataagatatgtcttcaagagatgcttgatatcactgttaactgtggaattgcaaggaagagaagtccaagaaatccagtgtttcaagactacgcttttaattttactgtctgtatcattaaggacttaattacagagaatagagtcaacgcaagctagttcaaagagaaaggatattgttcttatctagagtggaaggttaaaaaaatagactttatgctgaccttccataaaaaagtccctaaaccacctgggactgccaagggaactgctaagaagttgtaaaattgggaattttcctaccaatttgggaagccacaattatatttgtttattctagaactactccatgttttctaccataaagaagccatgtccctcattattaaaacgtcaaaaaaataaaagatgttggcgaggatgtggagagaagggaatccttatacattgttggtggaattgtaaattaatccaacctgtatggaaaacaatatagagatttctcaaagaactaaaaatagaactaccatttgatccagcaatcccacccctgtgtatatacccaaaggaaaagaaatcattatacaaaaagacacttgcacttgtatgtttacagctgcactattcacaagagcaaagctatggaatcaatctaagtgtgcatcaagagatgattggatagagaaaatgtgatacacacacacacacacacacacacacaatggaatactactcagccataacaaaaagaatgaaatcatgtcctttgcaacaacatggatggaactggaggccattaagtaaactaactcagaaactgaaagtcaaatactatatgttctcacttataagtggaagctaaataatgtgtacacatggacatagagtgtggagtaataatagagtttcagaagggtaagggtgggtggggatgagaaatgagaaattacttaatgggtataatgtgtacactatttgggtgataatgataccaaaagcctagacttcaccactatgcaacatatccatgtcacaaaattgcacttgtaccctctaaatttatgccaataaataaataaattgccatgtccccagttaagaagttgtcagcagctatgggaactggcagaagctagccttcaaaataggccccagtgatctttacctcttagtatccatcctattgtgttgtcctcttccccattgaatagggctgatctgttggaccaacaggatactgtggaagtaacagtgtgtgccttttgagactatgtcataaaagatattgcctcttccactttgccctttcttggatcacttctaccagaggaagccaactaccatgttatgagaacattcatgcaacactctgtggagaaatccatgtggagacaaatagagatctcttccaaccatcagcaccaacttgccagtcatgtgagtgagccactgtggaagcggattctccagccccagtcaatcctttgactgcagtcccagccaagatatgacagcaatctcaagagagactccaagccagaattggccagctaagttgctcccaaatccctgacccacagaaattgtgagagataatatgtttgttgttttaagacactgatttttggggtaatttttactgcaggaatagtataggtatcaacatcctgagcattaatccttgcttcaatgtgcactgcctttcctctccttcactgctcactccaatgatctaagctcaagagttgagagtttgtagaggtaaatctgcagttctctgtgaatggactggactcttccaccttctagttcatccttcactactagatttctaataatggtttctattggactaacctcccacagacaacaactatatctggatatatatacatatatatatatacatacacacatatatatatacatatatatatatacacacacacatatatatacacatatatatgtatatatatgtgtgtgtgtgtgtgtgtgtgtgtgtatactacaacctgcatacatgtgtagaagttctgcagtaccaaattgtaagcaagcagaattaggaactgtttttttttttttgtttgtttgtttttattaggtccaaaaggtacatagaaaagttctgcaagatttccagtgggaaaccggttctctagagagaggctattaattaatctttagaaatgtccccaaattttgatgcagggtatttacttttaaaataccatagtggattcattgatcttcaaatagtctgttgatcttgttgggaaaagtgcttgcaatattccaagtcatcaggtaaattggtttgaaggaatccaagtagttccttaaatgtcagctcatcttcaaggtttgaacctttcagggtatggggcaaagggcacaggctgacttgtcaaagcaagagagctttaacaaaggtagaggcagatatatgcttgcttaattgtaacaaatgatctcctgaacttttccttttttcttttatttccataagtttttggagaacaggtggctatttggttacatgagtaagttctttggtggtgatttgtgagattttggtgcacccatcacctgagcagtgtacactgaacccaatttgtagtcttttatccttcaccctcttcccacccctattgaacttttcatggtttccagttggtcactatttgacattcctctatgagccatgccattgacctttctgatacatctgaagaagacagaagtcaaaaactggcttctagtatgctctgtgaacaaaatcatgtttgtaaatagagtgtaaacctattggcagttcagcaatcgccctgcctaatattaaaaaaaaatgttaaatctgctttctgtgttaaatctctgtatgttagaatttatctattgtttctataaggtccaaaaggtgcacagaaaagttctgcaagattttcagtgggaaaccagtgggaaacatcattcacttagtcattttatttaggaatagattgtgaaccaaactgatattctaaaaatggaggaaaaatttcaagatttgcatgggagaattgaggagtctggctactggttaaaaaccaatgtgtgatttttcaggcctgatcataggcgatgacgaagactttacctggcaggcttcactgggaaagctgccctccacacaccagacttggtgcacagccagcgtatggcagtctctgtggggtgttgcagtcaaagactcagaccccctggccaatcatgctctttcacatatttacattcctagccctgtgccttcatttctaggccctttatctgaggccttgggcaagaggtcttcaggttcctctgctgagatcttatggggtaaggaaaagggaaaaaatttgaagatactttccttcactctgcctcagtgcccaggacttttccactcctaccccaccacatgactccagggtccgtaaaactgccagagccttttgttcgggactccctcaatataaagatgaccccacgtctgtgctgctccacttgaatcttgaccagcgtgctgtcccacaggggaaaatggaagagtgaagttgatgcttcctctggttttagactgtgactgaaggcttaactctttcattttcagcttgtggctttaattggctacttgaacacctgacagctcagctctctcccagctcagcagagctcctaaaaagactaattaaattttttccattcttaaaacaccactaagaatcacaatcctaaaaccactgaccacactgaacaagtatggctggtgcttgacaaacaaagtgagttctactaaatttgctccaaaacattttgttttattaataaaagtcttacttaaaaaacaaaatagaaaagagttaggtgtcacattgaataacatgttgatagcctgtgtatggttatgggttctaatttctctacaaaatcaagcagccatgatggagtaaagaaagttagaaagagtaaatatggtcatataattttttgaaacacttccaagtacaaaaagcagcatgctaatttttaagtgcaaagaaagctcataataaaatagacttttaaaattacaaataaaatctgtacatcaaggatatttttaaggctttcccgtgtgcatgtcactatgtagacaatgaagaggaattgccaagagaggaaccatcatgtcaggtgttacaggtctggctcatttcggcttgtaggaccatctcttcttttctcaagggaaaagtgtcaatcaggttgaacagggccacaggcatcaccagggagacatagcgctctttgtccatgccatgcttatccactagcaccatactgaaggagtagagtgggattcgcagcaacagcctgtggcagacaaagaaaagaggagactaagtcaaaccatgactcccaagggtcctggtggatcaaccagagccttactgtgacagtgtgcagagaaagctttgatacaatgaaggactgaatcatcctttagaccctgtctactccaactgtgacccttgaaccagcagcatcacatgagaacttgctagaaatggagactctcatgcccaaccccaaacctactgaattagtgtctgcattactatcaagatccccagatgactggtatgtacctgagaggttgaaaagcactgctttggttttagattatagtcaggaagacttcaggcgtacaatggtgccacataccaacgtttggtacaaggtgcatacaaggctaacagattttttttattaaattggaatcaatccaagtttggaatcaacccaaaacccacgtttgctgactagtgttgcacgaccacatacacactaggacaaagtcagtgattatgaacaggggtgattttgctccccacccccaggggaaatttggccatgtctggagatatttttggttgtcacagtggagagtgaagatgtgaccggcatttagtgggtagaggccaggaatgctgctaaacatcttgcaatgcacagccaactgtccccaccaaacaaagaattatctgttcccacatagcaatagtgccaaggctgagaaactctgggctaggtaaagctgattgatataatttcccagcatgatagttctggcctgttcagtggccagctcaggactgcagagttataagggattgagcttggtctacagcccatgtattctgacttgattaatcataatttgtaccccaaataattccaaaaaagaatatgaagtggtttcaagtgtctggtgttctttctgctctaccacactagaatttaaactaaaaaatatgatttttatatcaacacaaacatatttagatgggaatagctagagaaagcaaacaaacagataagctgagcccaatgaataaatgagcccactcagtctcttctccagatttttttttcagtttagatattttgagattatgtatgaggcagaatatacactgccatctggatttaaagtaaaatatgttttcctcatacaaacagatcaaggttaaaaaatcattacatagaacacaaactacttttttctgccttttaagagggagtttcgaggaagaagggaataatttgtattttatcccagtggggagctaaattgccagttcactcccagtgactagaaatgaaataaagaggacatgacaatacctctgccaggtttcctgcagtgctaagaggggagctcagaagtagatgactgcaaagtgcattaatgagttctgaacacgcgaatgtaggctgcaaaggtgtgaatgaagagataaaatgctctgcatctttaaggggaaggatattgagttttcttttgggagcgtggaggagttctggtacagggagctctcaggaaacagaggaatagggaatgtggtggctgaagcctgtgggaaagggtgaccaataagaaattggagcattcattttttttatagtgcttgtgagactaggatgggaacccccaccaccaccaccacggtgccaccatctgctaccatacacattcctgtgtaagtcttgtgccttcattgacacagaatgtaaagagggaaaactgtcatgggaagagctgagtggttggatcagcaggctagcagcagccacaggaatgcatcccactagggccgaaagaccacagaaatcttggggatgaatgatcaaacaccacacaaaatcggggatgaggtgtgatgccgacagtatgcctgagttacatatgtgtctgtcgtcagattggaaggagttcttcctggaaagtcttccagggaacactgtagactcaaagaataatgtgggtatagaaactatggctttcttggtccctgtcttccttgagattgctggaaaattcctctggaaagcatgaatcagatcatacctccagataaaaaagaaatgagggtaagaaagaaggtaggcggtgaccctgcaaccccaggcacccagtctcttctttctgttgactcccttcaagggttttatcacggccttggtgctatttgaaaatagccagacaagagaatttttacattatgcaggcattatgcttttccttctcctcttttgcttcccattctttgcctaaatcatcttttttcctctgcactagactccaaggtgtctaaaaaacacctttccaattcaaagggaaaaagttctgccaagctctttgtttctcactgatatgtttgataacacaggcatgccggcctgacacagaatccattaggtaatgcacctgagtgatcatttctgtatgacatttacctggactatcatccagctgcaaaatagtgattgaccctttccttgaaggctgctgggcaaaaattctatttcaaactgtaaaggctttggtaaaaaactaggccagtggtcctcaccatgtggtctcttgggagctcacgagaaatgcaaattctcgggtacgaccagagacctactgaatcagaaacacagtttagagcctacagtgtagactccagcaatacgtattttaacaagccctccaggggattctgatggaggttaaaaatttgagaaccacgacataatgtatttaaaaattatcttcagcctatagaagtctatggtagccccaatatatacaatctgaatgacaagtattttttaatcacatttttctgttcttcaagtagattaaacagtttaaaatcacatcaagattttatgaagatgacatacacacacacatacacacacattcaatccaaagaccattcagaaaattctgcaacaagttttaaaaaatcattgacacaggatatgagcaagtagttctaaataagcaacagcttcataaaacctactttgaaaatattcaccataaatatttagatatcaacacaactctctgtcttaagttttgtacacttcaacttgaagtatttgtatactaactgtagatatacaatatacttttaaaagctattatcacctctggaaatagtaaggctgtttcaatgaaattttgagtcatttactccacttagcgccaacatggtgccaggtactgtgctaggtactgagtagccaatatttgaaagctctgctactgaagtcggtatggggaggtgctacatgcaaatgcagtaaaatataacaaaaacaaaagcatatgagtgtacccagccttctccattcatcagccgactaaagagaactcatgaatcatcttatttttcttccatcctggccctctgagttttttctttctttctttctttctttttttttttttttttttttttttaccttggtaggaatgtggcagaatctttttgggtggaaagtggtacaaatcaaacatgggatgggtcaaaggcagctggaaaacagggaaattagagaaagaagctattgtgtctatctatagcatcatttgctaaggatatgtttctatcatataacctctcaaggaatttctgtgccttctgaacaggtgtgatagggtttaccaagtcccatttcattttcttctttctggcaatacagaaagactgcatttcccagcctcccttaaaagtgaattgcaatcatgtaactagttctggccaatgaactaagagagtgagcaaggtgtggcacctccaacgtgaagcataaaggagtcagtgtgagtttttactctctttccccacttttgcagaagcctgaaagccacgtgttcgagatgtttgtaactgcctgaggccctgagagacagggagcagcctgggaccctgaaaacagagatctgtactctcccatgcagtgtgtgagagaaaaggctgggtgagaaaggaagattttaaggagttttgctttagcctaattatcgatttcacagtggtcaagagatgcaagtagaaatttgggttattctgaaattaccttttggttgttgaattctgcttctttaatacatcattattcagagactaaaatccatggctccaactttgtaagggttatgaaactaaaatataattgttaaaataaaggtatgaacaagtgttctggaagcatggagaaaaaagagaccaagcctgggaagtctaattggatgcatgctcttctaataagaccatgattgcttaagtcttttcttcaggtgctcctctcctaaccatccttcctccaccaaccacacacacacatacacacacatgaagcaaaaacggttggttggagggagtaagaaagaacactggtaattacccactgcacaatttatttgaacaaacagcaacatactgattagtatggttataacactcccagaataaaagcaattaaacattgaaggttgcctgaactcaatcctgaatagaaagaaaccagggaacctaatcagttaaaaatgcattcacaggggataagatttaagaacagaacttccccctacctgagctgcagcgctagggctggaggcataatctttgctcctatcctgccaatgagagtcgggaacacacccaccagctccaccacggtgatgtgtcgaagatcaaggccacactgtgcttgctgggaaaaagaaaacccaacaggggaagtatgagcatggctaaaaaagacatccttatcaaactagaaaccgacagaagcagcactggcctgtctctggaagtttatttgctcactctgaactgtcctgaaaacagatgagaaattggggttaagatagtggctataaaacctaaatacctttgctagaggaatcattcagatatggcttgacagtgggattttgaaaacctaagcaaaagggcagtctatgtatttccagacagggtgagaccttgagtgagtcaaatttcctaaaaagtatccaagaccaccccagaggattctaatttttctttgcaaggagagaagactatttccagagtccacttctctgccctgtttccactctccacactcccctgccctatgccctccacacccaatcccaggggaaaagaggataaaaggttccaagcctctaagctggctcttggcaagaaccttgggaatgtggcccagtcaaccacgaggagggctcatcaggaatggcaatggcaataaaaaaaaaaaaagtaatgtaagacaaatatgatgaatttggctaaatgggaaaagaaattttgaagtcttgaaagacgaaaacatcaaatatgttttaccaaaattccactgaaacgtccctatatgaggttacagaactggttgaaaagtttaaaaagttagaaatagacttttgtattactctcactgaaatgcctaagtcaatcaaacctttctttgaaggctctggttaaaatgcaaatgtaagtatatttggaggaggagggcacaccaaaacatcttgatataaaatatcttatccaaccagttgttaagttagcaagtgtctgaagggatgggacagactagagcaacgatggcaatctttctctgtaaagggccagagagtacttcaggcttggcaaggttggattgcctctgtcctaaccacttcacccatcattgtagtgcaaaagcagttgtagatcatgcacaaatgaattagtgtggctgtgtccaataaaagttaatttaccgaaactagccatgggtcaccatagtttgctgacacagaggaaaagcaagttgtttggcttaattcattttcctatggaataagaagagatgaggaaatgcatgatcatggaatatagcctgcaatgccagtttcccacaaaagacagaggtataagcttgtgttttctgaagagcaagcccctggcttggacaaggagatacaaggggaggtaagctggtggggaccaggggtaaagatgcaatgaatttggttcctatcaagggaactcacaaaaattttatatggctcttcagagttcataggcaattcttcaagtacgtgggaagagtgaaaagagacttattattatccattttattaatgctgatatgagaagtaaattgtagcctttgattaaatcaatactgttctaagcacttagttctatccactgtaataaatgaataaaatagtctcaaaaaaatgtgcagcactgtatccatggcacagcatacatcctgcctctttagtattcagtgaagttggccactcttttgcaaaccagcctcaggacaaaagcaagcaatttctagtttgatccttacagtttctagtcagccttccccacacacccaagatgttggttgcctcatttagtagctacaaaatttacatagctgagaaggacacatttcccagaaaagtgaccctcaaactttagagtgcttaggaatcacctggagattttgttaaaagtgtagattctgacacagtaggtctgggaggggccctgagaattggcatgtctatcaagctcccaggtgatgctgatgcttctggtccggtccatggatcacacgttgagaaccacttttctaagaaaaaatggctgtcaccctctgagtcaaagaaattccctggggaaaaatgtgggcaggcaaccaattgattgcttccagccaggcatatcctggacaggtttggcaaagacaattgttctgtggctaggcctggacagcatgtcaattagacttattggtgaagacagacaaacctcattagttggaaaacgattgggttaactctaaggagtcaatgttaatcaggttatggcccagaaccagaaatgaatggtggtagctctaaagtgccacttcctgaaactcactgtaagtgcattaggcactgaatctggcctttgcttttagtgaaatggctgggcccttcctgttaaaggtctccctctcaccttggccctgcctcgaggactcacctgcagcattcctagctggagccggtaaaggaggtttcgggctgtgggtgtggacacaatgaggagtctccttttctcataaaactgatccagaagtgcagctgccgttctgacacccacattgacgttcatggctgtaatcagaaatggccacatgggtcagaaaccttccacttgttctggctcaacagagcctatgatgacacacagaaccatttgtgtaagaagtaaaccctgagataaggattcaagtgtaaacagtttatttgggaggcagtcccaagaagcgcctgtggaggagtacggaagtatattcacttcctcttgctgctgtaacaaatcaccataaacttagtgacttaacataatacaaacttattcttttagatactgcaggtcaggatctaaaagatcctggtctcatggagctaaaatcaaggtgttggcagggctatgctcccatggaggttctaggggagaatctgatttcttgtctttttcagcatcgagaggccacattcattccttggctagtagtcccttcctccatcttcaaagacagcagtgtagcatcttcaaatctctcttctctctgacctctccttccatcgtctctttctatgactctgacatcagttctgcctcctttatataagaaggcttgtgattacattgggcccactgggtaattcaggatactcttcccatttcaaaatccttaacttattacatctgtaaagtcccttttttcatgtaaggtaacatattctcaggttccagggactaggatgtggacatctttggtggaccattattctgtctatgtcaggaagtgagacagtgaaggaaagaaaacaataccaattggttatcaagcaagtttttgctgtgggcatttggaactcactcccactggggaactctaggagatgatatacaacatacctccagaattaacccactggagggaactggagtatttatacaattgctccatcattgctgagggctgcttctggggcactaactctccatcacttccagctggctctgtgcatgggctgacaatgctttcatagccaggaaagaaatgctctcagacagacagacccagttaattgcagtaagtagccttttgaacacagatgggaatgtgaaaggcatatgggccaagcaccatagtatctgctggggaaaggggtgcagagaggcagaagggtaagagaatgggcagtggccaggctggctttggaatggctcagaatctctgaagtctgcctccttggtgcagaagggacaaagcaatgtggggcacaaaggccacagagcaaacaacacaggcaaacaggacatgggacaaggcggttttataataggtcttccctttaagcaaataaatgacaactaattccagctgttcaaggtcaatgaaggatgtcgtatagataggcaagcaaaaggcttagccccagagaagaaataataagagaaaaactagtagatgccatgtatgatttataatcttggttttcatatttcacattttaggtttgcattgaagtatttgttcattcacacattcattcattcagccattatatactgagtgcctgccatgtgccaagctctatgctaggtactaggatgtcacactgagtgatacacagttcctgccctctttcctgccctcttccctgccccagggactcagagtctaggatagctctggtcaagagaaatacaatgtaagccactatatttaatcttaaattttctagttgcctcattaaaaaagtgtaaagagaccgggcgcagtgtctcacatctgtaatcccagcactttgggaggccgaggcgtgcagatcacgaggtcaggagatcaagaccatcctggctaacatggtgaaaccccgtctttactaaaaatacaaaaaattagccaggcgtggtggcaggcacctgtagtcccagctgctcgggaggctggggcaggagaatcactggaacccgggaggcagaggttgcagtgaaccgagatcgcgccactgcactctagcctgggtgacagagagagactacatctcaaacaaacaaacaaacaaacaaataaaaaatataaagagataggtagaaatgattttatgttttatctaacccaatatatccaaaatatttcatttcaacatgtaatcaatataaaaaattaagatactttatattctttttcacactaagattttgaaattggtatatattttacacttatagcatatctcaattcagaatagcctcataggtggtgggcatgaagtccttaggtagggagtctataataggtgtgttctttctactttaatacatgaaattgaagaatctcaggcatttagctgatggtatatatgtctctctgtcacttaactctaaatgggggcttcaattaaaagaaagtgataaagatgaaagggtgccaggaaatgagaaaaagagaagtctataaacaagagatacatacataattttctggctagtccaagtttcagactcattacccagcccaatttttcttcatcaggaataagagctggcataaggctttgcctgtaccaggcactgctctattccactgttccacagatgacctcatttaatccttacaactcaagaggtagatgaggtattattttcttcattttacataggaggaaagattccaaatgcccaaagtctatgtaactttcatgccagtgatgcaaagcaggtatgatattgtctctacatggcaatttactagctttataaataagatccttacatttctagaacaaaggaaactagagcaaattttgctgattcataatgtcaccaaaggctggccctaggttcctaccttgagcttcttccttagaggacatgaaaaggaaattagaggataggcaggggcaagatggatggcagatgagatgagctgcagcagggatctagggactatgttcatccactcagataaagagggatggccatgaacttctcaaagtatatgaagggaaacctctcttgcactggaatcaagaaccaaggggtttacaggttctgctgcaggctggaggggcggcatacctacctgcacaggtgggctccgtgccagaccaagccaggttggattgacatactcgggcagggctaccctggagctcatagccgccgatgcaggagaactcacaggtggctccataattatcaccgtcgctggagcacttcatgtaaccattctctggggcattgagtttgccacagcgtttgactgtagggacacaagtccagaggggtctcagtgctgagctcccatccacagagtaagcagaaaaggtgaggatgcagaggcatcagctttgcaatcaggcttctacatcagcctgtgaaatgagtgagggaggagggatgactatttggtcagtgagtgagtcttgcaatggtcaccatccataccaatgagaccactgatatcaactggtttcgcccctagtgttatagatgaggaagtgaagtccagaagagtaaggagtaaagatggttagcaattagttgcccaaaccatcaggcataaaataatccttaaaaacattttctttcataccaatggtactagaacactaaaaacatgttctcctggtggcccaaattagggggctcctattcaccctggttgtagatggactcacaggcttcagctggccacctaagctcagggatggaaaaattattgaataatattcttctaggacagtcagctatgggatcctgtaagactagtcctgggaactccttaaataatctggcaacactgacgcccatccggatgtgtatcgtgaaattcaggcattaagatagggcacttccccaagccttattagagactaatctaaagctggcaagtctcccaccacagtaggcacttgagagagttctggcttgaggacctacttccctttgctcttctaaagagagggggaaacaaaaccaataagcagtactcttacctcttactttaactcgaaatttgcaagtgcccttattctcagctctgtcatagactgtgtactggatcttgtggtctccttctggaaagttggagcctggggggaggccttttagaatgacacttagagaaaaaaaatcagaaacaggaaagatgacattatggacctgacaagcaagtgacgatcccctactctttacaggacatggagagactgaggggcaaccattagaccagtttaaataaaacaaaaatttcttgaagaatagaatctcctaagctttagtctgttttagaagagcagtttgtgaccagaaaatggaagacccaaactactgggaagcttagacttttttcttgctgaagggtagaatggtagggaagtgggtagaggggggagggaggatgaaaaatatagggcccaagtctcctccttcaatctcactcttgttccaggggggacctgaattgcctcactgttgggaagacgagggaattttctgtgaggaaaatcattagagaatatagtccaagcagtcactggcaatttgggcctgcggggcgggggtgggtgctagaactttctctgttctttctgtctgggacagtggagacctaaaggcaagttctctgtgattccttggttatcctaataacataataataatgacaaaaagtgttctttgcacttacataaaccttacatgttaggcatggttctaggcattttgcatatatttacttaatcctccttatttaatccaacaaccctataaggtaggtagtattatctctgattcacagatgaggaaactgaggcacaaaaaggctaaagaacttgcccaaggtcacacagctagggtgagtttatcttttttcttggctgcctaatgaggacaccaataagtatagcaggatcaaaatccacgttctgtttttcaatatacatataattccccatctccctacagttctgggaatgatgagaatatttgctaataatgaacacgtggaattatcattgtcaccattgaggaaagccttacatgtaggtgggtgaggtggctgtttaccaggtatgagagaggggtcttgggaaaatgtcagaaatcccactattttgagacatgctgctgttggctttagatgctttaaggtctttagaaagcacagtttaaattcagataaacctgagaggagtgatacttcaaatataagtggatgtaacctttctgagactttgtttcacctgtgacatgcaaataacagaaggagtaaataagggaactcacaagaagcacttgtctcagagcttgacactagaaccttctccctcacaagggagcgatagagcagtagcttggataggaaatggtggaaggggtcataggagaaatgccagggcagcaaggagccctagtgagagcgaaaagggaacaagacagccttctctgaactcctcatcctgttggagtgcattcccaccacatcctgctctaagcctttctggcctctgggttgtagaactctggaagcagacagctgctctgaacaaagggacaggagaatactgagatgctgttttaaaatgtaacaatcctgccgggtgcagtggctcatgaatgtaatcccagcacttttggaggctgaggcaggcagatcacctgaggtcaggagtgcaagaccagcctggccaacatggcaaaaacccatctctactaaaaatacaaaaattagcagggcatggtggtgcacacctgtaatcccagctactcaggagactgagtcaggagaatcacttgaacctgggaggcggaggttgctgtgagccaagatcgtgccactgcactccagcctgggcaacagagtgagaatctgtctcaaaaaataaaaaaatcaaataaaatgtaacactcctaaccatattacgcaagttacccataaaaagaacaaggtgaatattctcacaaagcttgtagacaaatagagtcatctgatggcttgatgttttgtgtttatcacacaggttttttcaacagcagtcagagctgcaaaaatctaaaaacctactacgtgctggggctgggccagacattgtgctagaccctgaagagtcaaaggtaaataaaacccaatccctgataacatcaacttacttttcaattctgattgcctacattttctccaaaggaatttgtgggatgtgtatgtgacagcaaataattttttaatggtcaaactttatctttgagaagttacaatgggagagcataactagtaatactacttaagctagatgaggcactgggggaagattattggaatgtaggaacaaaatgtcctgtctcctctcactagaaactgtactgttattgctaatcattgtgtaaaaatgttttgtcatgcacagcctgggttgataggattctagaaagtcttttcctgctttatggatcaccaggagataagttagaggtatcctttcatctacagatgaaaactcagtggggaactctaatatgcccataaactttaaggcacagatatgaatgtgctaacatgaagtagtggtctccagggaatatgaaggccaaccaaacagttgcaggggtacaggcccaaatgctagattagaacaacacatagctaaccctcacaaagggatccacccatttttaaaagcttcttaacagtgcttctcattgtgattggtaaaacaaacacaccaacaaaaagcaactcagatacatgtcaaactatgaatgaaattggtccaggagaatggggtagaggtggggaagaaagcagaagataccttctctttttttaaataagcatctgtaagtgtttgatatgatcgggagttttaaaaataaattaaaaagctttgaaagagataaatacagccaaaaaacaaggggtgaaaaagttttgcactaaactgtactcacagagcacaagagcggcagcctttggcaccacctgggagacacagatggcttcccagtgcaggtaatggcctgggggcatgagtagggtctgcctgggcaggcaatgggggtggctctattcttaaattaaccaactggcttcctctttccccttctgttcctccttcccttcttctcaccaccccttcttttacattttttttatttttaatttttgtgagtatatggtaggtatatatatttatggggtacatgagatttttttttttaatttttttgagatggcgtctcactctgtcacccaggctggagcacggtggtgcaatcttggctcactgcaacctcagcctcacaggttcaagcgattctcatgcctcagcctcctgagtagctgggattacaggtgtgtgccaccatgcctggctaatttttgtatttttagtagagatggggtttcaccatgttagccaggctggtctcaaacttctgacctcaagtgatccgcctgcctcgtcctcacaaagtgctgggattacaggcatgagccaccgcacccagccaagatgttttgatacaggcatgcaatgcataataatcacatcattcaccaccccttatttctcctttttccttcagtaaggatttactgagtgctaactatgtgccaggcacagttctgggcattaaggacatagcagtgaacatattataatagagacaggcaatcaacaaatacataggtgacatatatagtatgttaggtagtgaccagggggaccacatctgaaagcataaatagaccagcatatatacactcccctactctgggtagtaaacatctcacataaaagagacagcatcattttatctgccaagtttcacttactcagtaagaattccatctgctgtgtctcttccttcgggtgtctcccaggacacccggactgtcagtttgttgggttctgcaatgcgttccttcacacttgggcacttgattctaggaggttccatatctgaaaatataaccaaaacattctcatcatcatcaagaaatatctagtcaaactggggttcaacacccacagtttaaaataccaaagcctctgggtattctccattttcaaagagtttgttcaccctatatattccccttttctcccttcataatgcttttactctcctgctaagttttgaagattgtttaaatactcacatttgcagggctaaacctgcaatcaactggccttgcaaggtgtcctgtgggtaattcattagttacagcctttcctccccatgcttccaaactctgcctaccgaaggccacatggcagttacccagctgaaactagaagtcatttggctttagtgagtacttcctgctttgaacacagcatcatggaatattacagaaaggcattctagctatcatctagtcagattcaattcaaggcaacaaatttttcatgagtaccaatcttatccaaggcttcattccaactgctggggttgggggtgcacaaaggcaagagaatcatgtgctcctgacatttcagagaatttgccatgtattggagggattacattatcacacatgaaatataacatgaggtagaaaatggcaattgccccaggcaaggtaaaagtgaatgctatggaggtgtagaggagccgcccaactctctcattttacagatgtgcaaactgaggctcaaagaacttaaatgatttatttaagaccacacatgtagataatggcactgtgaattacaatctaagtcggagcacttgccactggaacaagctctctctcttcctgctatctattatcaacatattgcttaatatcttaaaataggcaatggtctgtctgggtccactctccccttgaactgctactgaactacacttatggttttatgttctgggacagcagttttactgtggctctggacctccaaaagcctcccaaatttcttcaagtagtttctctacctggtaataggagttctgcctcgatagtgataacaaggatgggtggttaatgagggctcaaagtaaatgagatgtcaactctacactgggttgtatttcatcttatagctgaagtgaaatcacaagaggaagttcacatttctgcaaattctacttaatatttctgaacaggtagagaatgtatttaaagaaggcatagcaaattaaggacattcagcttcatgttactttacatatcaactgataagtattaagtgctattactgccttaatgaaagttaaatgtccttttgattctgaatgacagatgtctttgagagactaaatgcaccaagtaaaattctttatatactttctcctgtgtcttgtctaataatttctcattttattcagggtaagaagttacgaataacttattaaacaattttgccttcagctatccaaattcattttcattctatgtcgtgcttcagtggagtgtgaacttaacagccttaatgcaccaatcctaaattgaataaccaccatattttgttgaatctaagtcactcctaattgtgaaatgcatccctatttcagggatattaaaaggtagaaataatacgcttctcagaattgataaaataaagtatacaaatactatgatgaaatggaagatgctttaaatgcattcaagatgtctatactcagctgttacgtttttaaaaacatttaattttttactatgataggtgatagaagacaaacttttataattcagatgaacatttcacagaaagacaagtatataatgactgccccctgctggtcaaatatagctggcaattacattatagaaagtatatttattagcatacagatttcaatgtaaaattacattgtgttaccatattttcttggtgcagcatggtcagagtgaaaagcaacttagtctctgtcaggtaaactaaatgtctggatgatacattgttgtttgttttctgtatcaagatgtactaacagtgtaagcacacaggctccaagataggttatctgggtgaagagtctcagagtttcccaaagccagcttatctctagctaacaatgatcagctgaactggcctagcttttcagaaacagtgctcttccaaagaagaaacaagaagaaataaatcattacaaataataactaatattggaggactccttcctacatgcccaccccatgctaagtaccctccctatattattttactgaatttgcacaaccacccattagactaagcagtgttattagcatcctcatttatagactgggaagaagcatttcctctcttttggaatttctttgtggtctgggatttttaaatgccattacatattttaaagctattttaataaaccaaacccttttgtgtatctgcctgctgctgacctagtgttttccgccaacctttgcacacatactgttttgtgatggtctgtcatagcttccccatgaacccttgaagagcctctgcaggacttgatcctgacacatcctcaagcagctgccttctctctcggctggtgagacaagctggtctgcccttcagctgatgctccagagacctaagcctgttattacccagacttggccccgatagcattttataagttatacatttccatgaatgaaaggaacaaagttactatagaaacataattactatcccctgttgaattaggatgcctgcaattatataaaaatcttgaaaccttcagtgaaaattctggcctttgctctctgccacattcattggagacatctgacaaactgtctcccttctctgtgctctagttatctctgtgcatataaaatatgagatacaaatatattgcattgtatcaactactatttatctaagaagctgaacttttttttcgagacaggctctcactctgtcacccaggctggagtgcagtggcacaatatcggctcactgcagccttgacttcccagactcatgtgatcctcccacctcagcctcccaagtagctgggactacaggcatgcaccaccatgcctagctgattttatttattcatttatttatttatttttgtagagacaggattttgccatgttgcccaggctggtctcgaactcctgggctcaagaaatctgcctgtcttagcctcccaaagtgctgggattacaggtgtgagccaccagcacccagctgaagctgaactatttacttggaaatccttgacacatctaacccggtaggtagtggaaataaggaagaagctcaaaaggacaaagtcttgcccaacagataacaataaaatgcaagggaagtgaccctgtgccagttccagacctaggccctcaaagaatctggtgccttctgctttcactatgttaaaagccagctgccatctaaagaagtccaattgactggagaggccatgtaatcaggatgagaaattataaatgagagagagagagagaaagagactcagccagaccccagtcagtacaacttttcccaactgaggtaccagacctgtgagtgaagccatcttgaatcctccagctccacttggtcacctcaaccattaccacatacagcagagatgagctgtccccacagagctctgcccaactttccaacccatagaatctttgagcaataacatagttgtttggagccactaagttttgtgtggtctattgtgcagcaacagatcactgatgcaaatataaaatagtttgagtttggtgatagagaaaggaagagttcttttcaagggggcataggaagtgagtgactgccaaatgcagaacaaacctggccattgaaaactcatccagttgtttgcttcccccagccagagcgtaatctctgtggatggctctgggaagtggtttcctctgtttggcaccatacaaaaatccagagaactttccaaaacagacaaaagaggcaagaagggaggcaatgaaatccacatttaaaagtcatgatcatagccgggtgtggtggctcatgcctgtagccccagctactcaggaggctgatgtgggaggatcacttaagcctgggagttcaagaccagcctggacgacatagcaagaggccagcctgggcaacataatgagacctcatctctaaaagtcaacatcttcacaagaaagaagcccaaataaaaattcattggtgatacatttatattagagagagccactaaaagttgacctgttctgtttgtactaacaaatcatgtaagggaaaaagtgaatcagtatctcagtcaatcaagttgttttaactgaaactagcctctgaaagtttgcaaaagaatgtgtatttgtcaacccaggaagaatttagcacaatttaacatcatttgcaacaatgcatggatacattcattcttagccctactgatgtttgcatcaactgaataatgcaatgcagcccagcaataatgcaatgatcccattcctatgggtcattgggtaaaccagctgtgagacagctgggacacaagaaacgtatgccatcaatttccatatattacatctccaaaatgttttattccagaatttcatttgtgttaataaatctccacctattctactctgtagaaaacaaaaaataagtgagcaaaaaataaaatatatttatttaaaaatattttttccttgatagataattagaacttaaatgtgttgtctggtcactttattacaatccgttccacagggcaaaaaggaaagtttgtacattgtcttttgttaaagtaattaaatggatactctctgaatgtcaaaagacctttgctggtttttcattgtccgtggtttttaaagtatctttaatttgttttcttcctgttttggcctaggaagaagtgttggtctaaaggagagatcatgtgtctactcaaaatctggtctttacatgaggacttgttgtgattccaactgttcattgttctatctaaatgccaacataaccaaaaataactaaaaatggaaagaaagaaaaatatcccccgaaaacaatagtggttacattctaaggtttattttcttccagatcaatggaggttgtggctcttcaaagactttttaccctcctgcaatttgcagtattttttttcctcctacattgacttatttttatctatatctgtttctgaaataactatgaatttcagctcattgccagagtatggtctgtgtaagagaattaattttaacttgtggcaccttcaaattagccagaccacagaactgaccacctcagagtccaaagtaagcccagtcttctctcttccctcacagtctagaagagaactgggacaactttctcaccactcagtacagctctggccaagactgttgaaggttgtgtggaaatctgggaactacttagccactatgtgtcacctcctaaaataggttgaagttctgagttacgctcaaggaccccctacccctgtcaacacaaaaacaaatttattaaactattttaatacatttaaagccaaaaaagtaaataatacccctggagtaaaattcactggggacaaacctcagcttgtctgtcgcgaaaatcaaagaaagaattgcctgcttgctttgcccatttctctcttttttcctgggagctctaggctctcttgtggatcgctgtacccctttttgtcatccctaactaattgcatgtacaatcctccttctcccaaatatgcctgaaccttgttctgacaaactgtaatatgaatctcctgaatttggggttcattctctcttcctctgggaaggttccaggcgcatctggtccagcttaagacatgctgttggtttttgagaacaatcagcattttctttccattgttgcacacaatctggaaatttaaacagtatgatccctagagtactctgccaaagcttgcttagcagaaagatttttgagcttctctcctcccaccatcacctctgccccttccaatatgagggagtagattcaattttctttttggtttgttttgaagagctatgcacatagctaatcacagggaggatattgaaagcaacatctgtgaggtgccccctgtgggcagtgttactggcacttagtgaataaaatccaaggatgctgctaaacatcctgcaaacaaaaaaaacagggctccacaacaaagaattatttggccccaaatgtccatcatgctgaggttcagaaactttgccctaaagcatcgtttagcagaatcctaggacccaccgcagacctgctgaatttaaatctgcatttttcccaaggtccctagaggacttcgctgcacagtaaagtttgagaagcagtgccttagatcagtagctctctatttgagtgcctcacaatccctggaatgctcattaaaaaacaaaatgctgtgcctgacccctaaagtttctgactcagcaggtggtgggggtgggttggtaaaaatttgcattcttagaccaggagatgctactgctgcttctgctcccaggaccacaccatgggaaccactcactgcccaacaaacccagagtaaggcaaaatatccaaatcccttccagctgaacaaattgagtgcttgctgaccaccagagtcaatgacaaagaagctacattggggctgaaagacacatagatgttctctactggactgtccctatagtgtcaataactttgctcaggcccccgaactaaaatcagcaggagtatgccacatctctgccagcctgtagttgcctcaatagcaaaccaagaaaaagacaaaagtcagatggaagccatcagctacgaagtcagctccaggatagacactgaggttagatctagggctgagccagagaaccagtgatgctactgagagcaaagttgcatgcttaggccttacaggaggaatagtgatgctccctttacaatccacgatgtgaacaccccctgctcctcccaaagcaagtgcctcctaagggctgtggcattttcttacccacacaggaggctggccggccgctccaggccttgttgtccatacatgtgacggtccgctcccctttcaacgtgtatcctggtgaacaataatactcacaccgggagttaaagtaggcaccatctacacacttaaaccctccatttgctggcatggcaagggtaggacatcgcttttctgaaaatgagaaaatcagatattcagcatttcttagtttttgtctatagagtttcatttcagagtctagaaactctgaaagcatgaggtgaaaagttaatttaaatataagaaggccaggcgcagtggctcactcctgtaatcccagcactttgggaggtcgaggcaggtggatcacctgacttcgggagttcgagaccagcctgaccaacatggagaaaccccatctctactaaaagtacaaaattagccaggcgtggtggcgcatgcctgtaatcccagctactcgggaggctacggcaggaggatcgcttgaacccaggaggcagaggttgcggcgagctgagattgcgccattgcgctccagcctgggcaacaagaacacgactttgtataaataaataaaacaaatggaatttaagaaacaatggatggttttatgtcacacagaagacacaaagtttcctgtcacactggcttgggttggcaacccagctaagccactatcttaggttgagctccccagaagcagattctgagatacggatttatgtgcatgaggtttagtaagaaagtgctcccagggagactagtgagggggtgaggaaagcagaacagggaaggggagaaatccaggcaagatgagatctcaggcaaagtcagcagcagcctgatcccatagggaagctctggagtgtgaatgacagctcattctgtcctgcccccaggcaaggaagctgggctttcataattctttatcagtcagtcattgggcagctacaggctgctcacaggagatgctttctcttgtgaaaagagaacgagagtgagagagtgagagagagagagagcgagtgggatcagtcctctgaaggagcagtcttctgaataaggttgaagttccaagtctttaagagcaaagtactcagaagctgggtactggatacatacaactagtaaaaggcatcgaggagatctgggtagagcagattgtccactacagtcacccagttgcagagtctgcatagtctcgatgacatggctgcagccttgaaacctcagtttccctgacaatgaagttaacataatggcacccatattgatagtgttactgtaaaaatcaaatgtatgtgaaattcttggcaaaccataagcgctcaaaaagtggtggctgttttgaataccaaagacatctaaaatgtgcttcaacaatgctgtaccacttgcaattttccaaatgaggtatgacttgtcatgaagctaaaagccagcccctgaaatgctgctcctctaagcttctcccttgaggcacactcactttcataaataagcatcacttcttctgtgactctttcctgcctccctaagccccactccttgggagaacactttttttttctttttttttaagagatggagtcttgctctgtcacccaggttggagtgcagtggcacaatctcggctcactacaacctccgcctcccgggttctagcaattctcctgcctcagcctcctgagtagctgggattacagatgcacgctgccacacccagctaattttttgtattttagtagagatggggtttcaccgtgttgctcaggctggtgtcgaactcctgagctcaggcaacccacccgcctcggcctcccaaagtgctgggattacaggcatgagccactgcgcccagccaggagaactcttctttaatctgctaccatatgtccctgactttgtacccttcttgtacttatctcccagttgacacctctgccttactaaagcctcttcatggcaggacccatgtgcgtcttatttgtttctaaatccccaacacctcttcaggatccagcactaactgaacaaatgtaactcattttctgaacaatgatcttctctccccttttctcaaacagctgatcatatcattctctctgagaggagccaactcacttccaccatatcttagaatccccctggtgtccccctgatcataaggagaatttttctcatcaatattcagtgaaaatcctcaatctcagagcaaaagaactttggctctggtcatccctgaggacccaacacagagctggcctactcacgtttgcagatgaccttgtcagaccatcgtttgtttgactggcagatcagtagggaagagccatgcagctcgtagcccttctggcagcgaatgtcgcacctggttcccagggctgttttgtagtatcctccttgaggggccctgcagtacacatccccatacttcaccttgatgggggagcaccacggggtatctacaagtagcagaaacaaaagaggagataaatatgaaatgacactttcagaaaatgtgtccccttactcttactgtcccaggctggctacattccaaattttggaccttcaattagtgccccatgttttcttaggtgtctccgggtagggaggttatgatcatgggactaagtgtcagatatatctgaacatgaatctgagttcctctataactgactgtgtgatcttagacaagttagctaacctctctgagtcaatatctatacttatgccatagtgctgttacaaggacgaaataaaaattgcatatcaagcatctagcacagtacctagcatatatgttcaataaatgcttgttctttttagtatttcccttaactagatacataagattttttatttttattttttagataattctttcaagggcaactgatgtcatacatagcggtagggattcaataattggttaatttggatttcgtctgagccgtatgcacattctctctaaaatgttgtaatactggcattaatctaaatgatgctacaatttccaggtgtttgtaacaagatataaatttcgcttaaagtcacagaacaattgctctccatagagaagtgtccccagttatgccccatttacgtaacagggtgacaccctccccagatggcaaagttgcaggtgttttgattttggtctcatagttgcccaaagcacagctgggatgaaatgaataaatcagaacctccctgctgtgcttttgaaatgttctctttgagatccataaaatataagggcaacactagctccttggtggataagttcctacagcagccactgccccattgtcccacaattgatggggaacagtgaggagttccctaaagcctgccgggctctcaatgccatgaataggagccacttccctgcaactgcctggctcatcactccaacccagcacctgagctgtcagtgagtgaggtaagaccgccatcatgtggccaggaaggaggacagaccctgttttactttcccaggaattctcttctgaggatatgcctccaactgcttctcagttacaaaaaccaacagttctggccacgtcttatgcatagaccactgttttagttttgccttcacatttccttcagctaatactttctcttttttttttcttttttagaaacagggtctcactctgtcacccaggctggagtgtagtggcatgatcattgctcactgcagtctcggcctcctaggctcaagtgatcctcctgtctcagcttcccaagtagctggaactacaggcacgcaccaccgtccctggtctggctaatactttcgtcatatcatgttttgcagacagctgcaagtgagccctaaactcaagactcaagtaatcttccctggactttctaggtaaaggtgatgtcctaaaggcttaacctagagctgattaaatttaaccatgtggatataaacgtgtaggagctcacacaaggcctaaagaacttccttgaataaattttccttcctctaagggttttaatataatctgtatgtactacatatatttgtgatatacagtactccccctttgcccacgggggatattggatgcctgaagccttggatagtacctaacgctatatatactgtttgtttcttacacaaacatacctatgatgaagtttaatttataaattaggcatgataaaagattaacaacaactaataataatatagaacaattataacaatatactgtaatgaaagttaggtgaatgtactgtctctctctcaaaatatctaatattttggggctgcggttgactgaaggtaaatggaaccttggaaagtgaaaccgcagataagggggaactaatgtatgtatatatatgacctgcatactcatacatcacaaactcactcaattaatatgaatatatgatggtattccaagcaaaagaatcaaaagccatgcttgccacataccaggagcaccgtaaatgttggttacatttaattttctttcttattttactttaattcaaaaacacttactctgtgctggacattgtgcaggggcctcaggatctaaaactaaaccctcacttaataatggcttgtctctagcttttaaaattaaaaaaacttggccaggtgcagtggctcacgcctgtaatcccagcactttgggaggccaaggtgggtggatcacctgaggttaggagttcgagaccagcctggccaacatagtgaaacccctgtctgtactaaaaatgcaacattagctgggtgtggtggcgtgtgcctgtagtcccagctacctgggaggctaagataggagaatcgcttgaacctgggaggcggatgttacagtgagccaagatcacgccactgcactacagcctgggtgacagggtgagactccatctcaaaaaataataataaaaataaataaaacttaaattttattgtatgaagcgcacaacatgatgctttgatatacttatacatactgaaatgattgctaccagtaagcaatttaactgacaatagaaacaatgccctaagaaaatttattcttaaacattcagggtaagttctagggcaagcacacattttggccatctggtctacctgtcacatttgcaatgctgtgaggtgaagatggatgtgaagaacaaggacctgagggcactaggcaacccctgctgtagatgtgaagggtcatctgtgcatgcatgtgttttaggaagatttttcaacaagggactcaaagaaaaaaaaatctaaacccataaatagttaagaagttttgcgaattagaacctttccttaccccaagcatctgattaacgtatttgtgctttgcttgattggttaattcctgaggctatggagatagaaactataggtaggaatgagtatttgcattcagatctcacaaaaaaatgtggtatgtgatgggaagcacacctgcacataagcaccaggcaccagtcattatattggaaatattgttcacttgtgtagaaaacaactgaaggacatctccagtcaaaagttgtccagtcctaccctgattctcctgtatctgagacacatcacaacaaacaagggccatgtcctcatcccaggaattaggacaaatttccagggcaaaatgccgcagtgaaactttgttaaccatttttttttttttttcaaattcttcctccactgtaagaggaactagattcagagagaaagcatctctaaatttaccttcatttctcccaggtttccctaagcttcagagaaatgtttcaccagtagaaatatttgtggacatacttacctgagtctggacagaaggttcttgtttaggctttttatacgtgctggggagtggattgctgggaatatgtagagatggagttctttatcattaagtttcatttgagcaacatactttaacataccgtttcagaagccatgctgggctcagaaagagcacgatgaaatgagcttatgaaaatcaagttttctccttccccattcatcttagtacattatcagcacttggtccagatttgaccttaggtggtttactctggatgattctggctgtaatgtatgaattaggcttgattttcactttcatcagctacagctgcctttgcagaagtgaggacagtaaagaaacttatgagaataaaatgaccattgggatgctgaaagacagcatttcagagatttccaatgcattttgctttatttccttttttaaaaaagggagtatatatatatatttttttttccttgatagataattagaacttaaatgtgttgtctggtcactttattacaatctgtttcacaaggcaaaaaggaaagttctcctggcaccagcaggtcctcattagcacataagcaaagcattcacctttatatctagggtgtgaatacccgacttcatcgtcttctagtggtgagtctcccgatcctacaataaaaaagaacagaaactgcagcaagaaaagccacatagtatggacgcatatttcaaagcattcctttgccacagaccatgcaggaggtgctattagaatgcagagccaagagcaaaagcttctgtggccattcatgaaggaacaaacaggagatctctcagagtgaaaccggctgagctgagattgccaaaaaccaagcaaaatgagcctcaaactgttttggaatcaccatatgccaagtgaaattctggaatagggaaacagagagagtcaacttcactctgagaagatgccaatgtatatgaatctcatgccaggggagatgcaataaaatgtgtgcatcagacacagtccacagtttccccagcagtcaaagaaaacccagtagaactgggtgtttatggtacctgaaaacaggtccatcttgtgaaataaatttaaatgcaagataaggaggtaaatcaaatgtcttatcttgacaaaagaaacacaaagttgcttctatatacagcatttgtaggaaatgaaggctgaaatagactatctgtgtgcttatttagaacctctcatgaacgtatggctcaagtaaaatttctttttttttttttttttttgagacggagtctcactctgttgctaggctggagtgcaatggtgtgattttggctcaccgcaacctccgcctcttgggttcaagggattctcctgcctcggcctcctgaatagctggaattacaggcatgtgccaccatgcctggctaattttgtatttttagtagagacgggatttctccatgttggtcaggctggtcgcgaactcccgacctcagatgatctgcccgcctcggcctcacaaagtgctgggattacaggcgtgagccaccgtgcccagccagtaaaatttcttaatgagcgttgctaccaataaaaaccacggcctcagagagaacgtctgtgtattattttaatttaactcatttgcaagctggagctgaatggtttttaaaatattaaatattgaattccagtgagcagtaaatccttaatccttgaagtggtagcagatgccaaacttcaaaactgtaatcttaaattcagagaacttccctccagacttcacagtctaattaatgactcgagttagctctgtcttggtcacgcatttagttgtagttacttgccaccataacagacaagaacatcctccactgtgaggttattcaaatccccatgcagctaatgagtaatggtccctgttccacttgtgttctggatgagagatgtagagtgtggaaactgaaagtggagaggagatgagggctggactgtgttcattaggaaaagacccgcaactacagaagcccaattctgtattttcctttgctgcagatttcctcaccttgtctctgcacacccagatgtgtacaaaattacaaactattcatcattgcatataaaaaaatgagcactggaaccagacacagtggctcatgcctgtaatctcagaaactagggaggctgagtgggagaattacttgagcccaggagttcaaaaaacagcctggataacatagtgagaacccatctcaaaaacaaaacaaaacaaaaaacaatgaaaaccaggaaacctacctaacaacatgaatcaaaggcctatgctcaaaccctttgatcaagtcattccacttctaggaatctacccaaggaaacagttgaactgcatgtctgcatgtgaaccttcaatcatccaaattaaaaaaaaatccagatacatgagcagcaagctttctccccccgcccagccctccaacacacatatacacacatacatatattttgccctcggttgtcatcctggttaacttgtctacagtatttacagcatttagtatgaatgactacccattcatttcatgaagctctcttctgcagtggcttccaaatgacaacagtttcccgattttcttcctcctttctaaacagactctctggacagcacatctagatcagcctgccatttggacataagtatttcccaggagtccagtattggtcctttacatatctccagactattttcctgggccatctcactcccatacttgcctcaaaccattccccatgtactgatgataaatccattgtttctagccttgaactgtctcctaagagccaagctagaatcttcaactgttgtctggatatctccacactcacactcaacctgctcaaaaccagattccttttcttatcaccaaatttgtgcatcccccagtgtttcccatttcagcaaataaccatcttccagctactctgccacatggaaaatctcagcctttttttcttctatcttcttcatctaccacattctaagataggaattaacttaaatatccaactacaagaaatggtcaatcatattatgatccattcataacataataatgttcattttgaagaggtttcttaacatgggaaaatattatagaatgctgaatgaataaagaaagaagcataacccccaaaatgcaaaaatgcattaagattttaaaatatggcaaagctcatgtgtgagaacaacaatatggatgaataaaactaaaataatattgtgagcaaagttggtcccagaagactatatactatatatacgactccttttttataaagttcaaaaacttctaacactaaattgttgggaaatacaaagatatgtacggtaatttttaacaaagcaaggagacctcttaccctttcctaatcttctcttcttgaacaactgagttctaaggcctttagagcaaggcagacatctgtaccagaaaggacagggaggcatggtaggccagagcaggatgtcagagcccaaacagggcatagagggaaaacaggggcaaagagagaatgcacatgggcagatagcccagcaggggaatcacagattagtaagataaggagggctttcacatgggtaaggcggaagaaagcctggcattgggttgaaaagtacagtttctagattcccttatccctaggttgtgaaagggtctacttttagtgatttggaaggaatcaaagggaaggaactcttttctacagttgtgcatgcagaaaataggctacagcagatgtgagtgttgtcaactgtgtccactgtcccctcatcagctttgtgtggtagggaggatagtgacgttggcagtggtgataatcacggcagcaacagtttcctagcctgagtgataggaggagtttctggcatctggactgaagtcatggtgccatttgacctttaatgcagacttcttgacttccattgctccagcccttccaattttgtgagtaccttatttcctgcattaaatcattttttgcataaaatacctagagaggattctgtttcctatattaaacctaacagatatttaagcaaaccaattaagaaatgaatatatggttttatagctttctcttagtaactggacactaccctaacacagggcacactgctttctacccacaagtcttttgtagataagagaggggacttttatgtgaacatagatgagtaaggaggaaaaaagaaaaaaaaaacctactggagtcaaacttactctttttccgaattggtctatctgctaagctaaatgcaatctgatttctgtgcaattgaattcacatgggaaaggaaataacacacactaagtgcctatgatatgtgtactatgctaggcaatttctatgcactatctcattaaatctatacaataacactggccatttggtactattttagatttatcattagggaaaccaagtctctaacgtctttacttgtccaaggttatgcagccagtaaatggtaaatcagggattcgaatcctgtctgcctggccttcaaatctatcattcttttttcactaggccttactgccttctgcgcctacaatttcaaagaaatgagatagctggctttgggatcactgataggcaaacagcaaatggcttcttcagtagtgtgagaacaaatatgccaagagtgggtcccacagaagcaaaatgaagaatccatgtgtagcagaagctgctggttgcctgtccagcagccattctccccttccttcttactaaaagatcacaggttgtgttcagcagcaatgtgtccctccccaaacgatgaaccatgatgactcttaagtcaaaaaattaattcccctttgccaggaattgctccagggataagcatgtaacccaatattggacaatggcaagtaaaatgaagtctgcttaggggcagggggagggagcttatgggaaagatttttctccctgataaaagagaaaactgcgcaaggagaagacttttccctcttttctgcctttcagctttggaggctattgtgtaaggataaacgtctgaagctggagcagccattttgcaaccacaaggtaagatgtcacaggactaaagattttcagttgaggatggcaaagtggatagataaaaagaacccaggaccttggatgatgtcaccagactacaacatcaaccttatacatcttacctccacaattcttgttaggtcaacaataaatatcctttcaatttaagccactgtgaatagcactgtttgttacatgcaactgtatgcatataaactgatacacaaatgaatgaaaactttactgcatattcttgatagattttttttttttttttgagacagggtctcgctctgttgcccaggagggagtgtagtggtatgatcccggcttactgcagcctccatctcctgggtccaagagattctcgtgcctcagcctactgagtagctgggattacaagcatgcaccactacgctcagctaatttttgtatttttactagagacagggtttcaccatgttggccaggctggtctcgaactagtgacctcaagtgatctgcccgcctgggcctcccaaagtgctgggattacaggcatgagccactgccctcagccttgataggtgttttttaagtgaaaagaaaataaatgggtattagctgccactctcagaaaatttccagtttattttcagcctgagctcatatattaacttctataaaaatatgatgactagtctgcaaaatagacaccctgaaagatacaataagctcgaagacagactcacttatgttcagtagactgtacttactaaagcagcagaggagctttatgtacattggggaaagattttccccaccattaaaatttttcaaaaggaagaaaaatagagaaagaagttggggaggatgggagaagggaggtttcttagtaaactttcctttatttataaaaggctatccctctagaattctgctaattgaggttttattatgacataactattaatcagtctacatatggttcagattaccactctggaaagaatgcttcagtgcttcttccacacaaatacaaattgtacgttggctcagaaatcagaaactcagagccatgtaggattctgtctctcagccatacctggagccaactgcatttataattttgctctccttgcaaaaactttctctaattcaacagattttcaaagaaatagccactctttttttttccaaagttcaaattagggtcttcctggcctatggaaccccacccattcattctgaatgtccaggtagataagatcatcgaggcaccaaagtcactcttaaataatacttattatatgtattgaaattacatcaggagactagatttctgaaggctagtagagtgttcctgctatcacgccataaggtttctcaccgtaaggtagggatgtggtagagatttaagactaatggaaaacttggcaaatttgctaaaactacatagttctttattgattatgatacctgacccaaattggtagatttgctggctctgtattatatttttagctcaaagtgttgggtttattttttagtcattttgaagacagttcttcattctttacattttgtttctcccttcatcattattctagacataattttaatattgtcagaaagaagcatatttaatagtaaattgcaccatcaattttatactgaaagtcaatgggaaaataaaatttactttgcagtagggattcttaacctgaggatcatggcctactacagaattaatgaaagggctttggagggcccatgaaccccttgtaattgaacatgttttttggtacatgcttttgatacatgccttttggtactagcatgctttttctaggggaaaaagatgttagctttcagtagattttaataaattttaaaagccatggtcttacagcattctttattgttaagcatgttagaatatttactgaagaagcatgtagtgtccttctttttgatatttaactcattttagtgttggggagagagaagcaaatatgtttttaaaaaggataaatgcttatcatactggtttcttctagattagtgctgtccaatgcaactttctgcaatgatggaaatattctttatctgtactgtcaaatacggcagccactagtcctatgtggttattaagcatttaaaatgtggctagtaaaacaagagaagtgaatgtttttatttcatttaattttagttaatttaaatttacatttaaatagccacatgtggttaatagctaccatactggatagcacaggcctagacctaactttttaaaagtattctatggagataaatcatgtctataaattgctcaggggtgggaactatgtctaatttaccttgtatacccagtatatgatttggaattggtaaaaatgttggagaaaaaagagaaaaatctgccttaaatttcttgtgacacataaattatgtcctcatgcttataattttggatggttttattctaatcagtccagcttccgtatataaatttaaactgtgacaatactgcagatttggatgtttacaaaagggtattttgtactattggaagccatagggtgtttatttgtgggagccagatgatttagtgctaacaaatgatctgccaatggattacagagcagctgtggtacagtatgaaggacatttgaatagcttctgaacaaagatcaaatccaaggcattgccagaaaaacatgatttaaagatgaaggcaaaattacggctgtaaaatcctttgttaaatcaaggtagtgccttaaagtaccttcagtcttacaaaaggccccttagagagattaagggtatctcaagttcctctcaatcaaacagagaagagtctatatctatgagatttgtaaggtggctaatagggtgaacttttgtctaatagagtgaattctaagaagattcacaggagacccacaaaattcttaaaagagttatatatgctgaaatatcactagcttgacttaggaaggcagagacattaaggaataaggagaggtctttgatcccctacaattatactgtcagaaagcaggctcagtgagctgcttagctgtgaatagatgctatttttctaaaaaaaaaaaaaaggggggggggagtgagtatattttgcatgttggtgggaaataatcactgggtgccagagggtagactctgatatgcagcttctaagatggcccccaattatccctgtcccctggcattcataaccttttgtaactcctcactttaagtgtggaatgaatttattaacttgcttctaatgaataaattttggcagaagggacaccatatctcttttgaagtcaagttataaaaagactgtggtgtccatcttgaatactgtctcacactctctctcttggatcactcattccgggtcaagttagctgccaagtcatgagggcgccctgtggagtggcccatgtgttgagggaccaaaagcctgccaacaataacataagtaaggttataagaagatctccccagctacacacacacataacacccacaagtcgagccatcagatgaaactgcaggccaagccaataacttgcttgcaacctcatgagagaccttgagccagctaaaccatgcccagatcctgacttataaaaattctaacataataaacagtatttgtttttaaaacaaaaggaggaaaaggtgtaggaagagtagaaagtacaaaaggaggaagggaaaaagaaagggcatttgccttaaagtcagaagattctgatgtacctctcagccttggtttaatagtcttctcttaggtcactgcggtagatactgcttattcctcaatcagatcccctttactcaggctggtgtgcccatctcctagctgctgggagcctttgactgcaaataactcacagttgccctcttctccagagaattgtcctcagctgataggagccacttcttcctccccacctgtttcctggaggcagccaatgtttgattgatatggaggaacatgaagccagacttctagcccccaaaggtgagtggaaggacaaccttgcagtatttatgtttctaagaaccctgtggtgctagaatttacctgagactctatccttgcttagctctttcttgcttcccttcctcaattataggtttttttcctgagagtattccctcaacaaaccataagctttgcttctaggaaaccaagctaagagagccactgagtctctctaagcctcaaataccccaattaggcatgcctcaacagggttgccataaattaaatggcataatatatatgttttagttttacaagtttctaatttgagggttcataatcacattttctacttaattatgtgagtataaattgaaggcctccacatccctgagctgctgtgtaaatgagtttcttgaaaaaatgtaaaaatatgacaaacttatatctggcatgatatactttttaaagtttaagcatgaaacatggtcaagaatctcagtgcttccaaagttttctgtgtgttttttaaaattcctctaacaatcctgtatgatttgtgatttagaaaatctttcataaacatatgtatatgtattcatcttaataaccaccaggaaaagccatacagtcaatctttttcagaaaagtaaactgttgtcaagtttactctatgagttcagatgatccagataataaaatttgctttaggaaaaagtgatttttaggctcaagacattaccatagtttacactttgaggtaggaaaaaccctgtggttccctatatgcctttatgacttaaaaacatttacaaaatggggactcaccaaaagttattttattgctgaaaggtgctattgccgggtctcttgtattcttgaagctcttgttaacacaggtgagtgtacaaacatttctagtgacagaaatgggctaacaaagggcctgtccatagcttgtgtggacacaggtacagtggtaacccttctctcctccatagctaaatctgcagaagcttctcttctggaaagtcctaatttatgggggcttttgaagaagcccagaagtcagttccgtatgcctgactagcaggcaagatctattctgttatatcttggcaaagtttcaacagaggagagatgtccaggagttgtgtgtaaaggtgtatatgtttgaaggagtagagcgaaaaagaaactttagcttttcagagcaccagcttcaaccccaagatgaaggctcagaacaagtacacagagaaccaggatctgtaaatgagacattcttccttggattccttacatccctaaataagtggcagactaatagataaaagcgcaagagtaagaaaagaggggaaatacacagaggaagattcttgttccaaatggaacaaagggatccagaaagattagtctaaaccttttgctaatcatggggaatgaactgaagaaaatgtttattaccagtgcttttcttgtggcagaagattcaacagaatgttcagatgaaacaagtttataggacatatcagacattcagcttaccaaatccctgtctttactaccatcataagtgcctcagcgataccaaccatcaactaagaatagtatgtttcaaactgttgaccccatttagtaggtcatgactagtatttttgtagtgaaatagaattgaaaatgtcagggtgcactgcacatataaagaataaaccttactttgtacaatttttgtttttatataggtgtatgtgtggtagggtatccccagtttgcatagcacagtcccattttatgcctgttgtcccagcattactttttcagctttactggggtataatgggcaaaattatatatatttaaggtttacaacatgatgttttgaaatacgtatccattgtgatataatcaccataatcaagctaattaacatatccatcacctcacatggttaccatctaacattattattaatagcattctctttcacactcaaaaccttcctgatttgtacaataaataatatattcactctaacaataggtcacagtagaatatatttcttcctgtgggtcttgtcaaaagtattagaaaaacagtgatttaaatactttgaaaacctacatttgttaagttaattcggtttcctccctcagaatgaaggaatctgaaaatctgagaaagcctttgggggatcggtggtagaagtctacttttatctgatttgttcagggcatagatgttatatcccatgaaacagcaagcagacactgagtttcctcaactgctcatggccatcctctctggtaggatgcaactgaaaaagccctgggattaagttccagtgccatcctgatttgggaagccacttttctttcctgagcctcagtttgctcatctgtaaaatgggacaccagaagtgtttagaagggcatagtacctgttttcaaattatgttaccctagaacactcccatcctcaacctctagctgggacaacagcagtcaagcaaatcaaattgccctcctccttctacacctggcaataaacaaattaccatggcacatcattttaaaaatctgcctggtctttcatttccattgcctctttaagtcctcagtgcaaccttatgaggcaggtatcattcagtgactagaatgtaaacctggggagggcaacaactctttgacactttgtttatgattgtattctcagctcagagaatgaagtgattatcagttataggagaacaaggattgaacttttctgattctaaatctcatgcaatttcactccttgtttctgtcttcatgactcagaaacctacctgaaagccctttccctcctctcagttcctttcttgtgtttaaagctatttcaaagcctagctcccccagtttatctttcctaaccattccattcacattgatgcactctgttcacatttttaaatcagcactgattttatgttgcgttggattttcagaagccatttcgagttttttcttcccagctagacatcaaactcttcagggaatacggtcagggtttgtttccccttactgcccctgtgaaactaacaaaggctctcaaaagttttcttccccttgagactttagcctacacattactgatatgctcaagctgttccatcaatatcagaatgagacatccatctccctcagtgaaggctgtacttacagaaacagatactgtatttaaggcacaaaaagctgcccaaataaagctgcgactggtacgtcgttcttggcagtaacccagcagtataacttacaaaattctggcacatcttggcaaaactgagaataactgaattcagagaagacagagtctaagaaaataaaataaaatcgccacagtgtgtactgagaattgtaggcagcaaacttttaattgccagctgtagattgatattttaatatagtacattaaatggcagagagagacagagagaagagagtgtgaagaaagatatttccagaaaacagcactgaaacactgaaatgaacatcatgagaatgcctgaaagtgacaggctgcagtctgctcagctgaaacctaaggcttcttccttataaaacattctccggttccccaacagggaatagaacacgagcacccaagaacaaaaacctggactttacttgaagttttttacagatggctattttatccagctctgcctgtgttgggaggtagaatcatttcttttctgggtagcttctctcttgaaagcaccgatttctccattcggtgcccttgaactgatagtcacacagtagctgttgtcagttattattatcttcactgggagactcaagctctagtgggaaagtgaaggtgcaactaagctgacggcaattctagttttcaaaatgatcatctgcaggcttttggcaatacctgttgtgtgaggctacaccccagcacacaatgcctggtgctagcacttcctaggtgtgatagacatctattgtgttcctctcaaagaaagaagagcctttcttttggaaaactgcattattcctcatacctatgtggttctagtagaggtgagtttatcctatcccttgactacaggagcaatcatatgaaccaattacatgaaccaatgagaatcttggaaggatttttctctggtggtaaaatgaggaagatgtgagccctgaagctgccaacgacaaagattaaatctcatacagaatgctaattcgagagaatgaagccatcaaagaaaagcaaaaacaaaacagagaaagagagaaagagagatcccacaatatttgagcccttggttccagtattgcttggccccacaagcatacctctgccctaacataagatgataagcccatcctttcttcaaagctttttcgaaactggtttctgtcatgtgccatcaagagtcctaacttaaacagtagaccatcaatttacatttgaatgaaatagatgactaaaacatacagcatgacatctggtttgagataagaaatcaatctcagtgtatcatttccaattccctatttcaaaacaatactatagctcagacttaacactttaaaattaaattaaaacattagtgagccattccataaatttagtgggaccagctttatttgcaataaaatacattagattagaataggggaaaatagcagatacttataatataccatacatagtaaaagtgagcattgtttcatgacacttttgtttcaattatacacagacacacacacacacacacacacacatataccatattttattgactctaaaacaacactttttaacattttaatttccctgaacccaagatgagctctataatcaatggaatggcatagtttaattggtatcatttttcttttttagtgatacctaaaataatggtgactgacgactgacagagttttggagttgatggcatactgtgtgcatggtatgtgtgtgttttggattgtgatataaaacatatttcttactgcaggtagcaatcaaaagagtttgaaaacaattgtattacacaccttatctagaactcccaagttgataatcagaatagtctttgctgtacatatcagctaagtcatttatccactctcatatttacataatgccttaacacactagttttttacagggttccccaaatggctttcttctcattgtggaaacttcctgatcctcatggggaaacctcaggcagcagaacaggcaagtggagataatatgttgcatggataggcttctggtgctatccaacgaataccacatttagcccactgcccagctaaagagagccccacaaagaggcacagcgtggcttgtaaccctgccaaagtatcagggcactgatgacaggggagtcatgtggcctctcacctacagatggcagcatccccaaagtgcatttataaatcagttgcttataatttgaaattggcttttccttggaaaccacattatcagtggtgatcaggtcccctagagagtccataagagctgttttaagccataatatagtcaaactctagatgtccctggggggatggctcagggtccactaaatggggaggccattctcgtccctctcatgcccgctgtcccctgccctgaaacacagcattcaggttcattctacttcctgtacaatcatcctgctacttttcagtctcgagctgctgacccagacagagtttaacaaagaggctaatatggatatggatatttatatgtgtgtcctgttttctgttattgagagtgctgtgatccaagattttgaagctcagaaattccagatgcaaacacaaattaccattttatttcttggctgctcttaaggatgctgcaacttgtcaatacaggagcctgcaggcatgttggccccttcccagtcccttgctggagaagggcctgcagtgacaggctccctttgtccttcccctaggaccaaggcaggctgtctgcagggaagggactggaggggctggtgaagtcctcatttgcagcgatgagggcagttctcagaaaccatgggccagtgaaaaaggcagtatgtgccctaaagggaactttgccaaaaattgagtctttctgagcaattttccagcatcctggtgtgcagatgaaagtccagggtaagaaggaaataaaaggtaaattaaatgaagtagcaactatttctccagccttttaccatgcaggagcagctttgtacagcaccatcttatctggtcttactggccaaggtagacaccagtgagtcctaacacagtccttacagtcctagcttgtaagagagaagaaatacctactatttagttaacagacactacctcaggcactgccttgggtgatttacatgaattatttaattcaatcaaggtactcacatgaattcacatgaaacctatccaaaaaagaaaggtggggagggggggaaatgcaaacacactattttgcagccctaacaaaacctgtcagtaattgttttgttagtatgggtcttttaatgttcttctatgtgtagtagtcaagtcacattcaaattttacacagcacaatcaaactgggtatgggatcttcatcattgttaaggctgcattagggaagttaagacagggcatttttagagcatgaatgccaatgcttcctagaaattcccctcttcaatgaaattctgagcaaggaattataaatgaaaaattaaagcaggcagcaaatgggaaacaccctaggcagtctttttctctcctcccttgatgaacacccaaaaattttcctcaaatgcttgcaaatggcaactttttgtctcattgtaaaatcttgaacaagtggtaggtcagccatctccactgagaattttctagtttgtaaatctgaagaggataatttgaggaggtacatatgtccttcaaacatcaaattacagattgctctggcacaatatcatgaaatacatttgaaagtaactaaaggttgaaaatggaatcaatttcaaagtcaagcaattaggatcctatttcaggcagtatggtgagccatgtagcctggctgtgcttacatgaaaatcaatgaaaaaaatccacttttagcttgcaagaaagtaagaaatactgtgaaagcaggatcctgattaggtaccagatattaaggctcaccttttattctgaggataactgccaaaactgagctttaatttccatggactggtgagaccttggatacagaagacaaactccagagactattcaaggtcatcagttttagaggagactgcctacatcccctcaccctcacctcctacataaagctgatataccaacagcctatactctcagtgtaaagagtgaaataaatccatcccatgtatagggactacaaagaaaagttctcatcttgtaccccagcagtgagtgaaagaaggaaaatccttcccctgagaattaataaccatattattattactattatattattactaaaataccactaacaataattaaaaccacagtcataccatttctgacccattagtttggaagaactctaaaaatataacaagatcaagtgttaacaaggatgttgagcaatggaaatacacattggtgctagaagtttagattggtataacttccttagtaaataatttggcattattgaacaaagtcaaagatatgtatgcatattatccagcaattcaactcctaggtacttagtctagagaaattcctgcacattgttcaagggagatagacaagaatcttcccaatagcactgtttacaagaacataaaactagcaacaacccaaaatgcacatcaagagtagcatggataaatgatggcatatttacacaatgggatcttacaagataacgtgaatgaaaaaatcacaactgcatgtaacaacatgagcaactcttaagaatctaatgttaagtgaagaaaagcaagcaagttatagaagactatattcagcatgtgtccatttatacacaagtcaaaagcatgcaaatgtaaataatgttttttgtttgtttgtttttggtttttttttttttttttttttttttttgagatacagtcttgctctgtcacccaggctggagtgcagtggcgcgatcttggctcactgcaacatccacttcctcggttcaagcaattctcctgcctcagcctcccaagtagctaggattacaggcacgtgccaccacgcccagctaatttttgtatttttagtagagatggagtttcaccatgttgaccaggctgttcttgaactcctgacttcaggtgatctgcctgcctcggcctcccaaagtgctggggttacaggcatgagccactttacccggctgtaaataatgtatttttagagatataaacatattctataaagaaaataataggaatgataaatacaaaatttaggacattggttacctctgaggagatagcgaaaggaaaagaatccaaaggaaagaatagcaaggactacagggtaaagtttttgctctttttttggtaagttcttattaaactggctggtaagtagaggtgtttgtggtttttttttttttttttttaccatacccatattatgtaaatattctttttttctactcattgtttaatttaaaatttttcaagcagagcaattaaaatatctttgatgcaaagagcttgttaggtttgtttctcatttgtttgcaatgataagaacatgtttatccaagaagttcttaaaaattaccatttgggcctccaactaaaagatatgctttgccaataaaattagagagtcttagatctggaaatactcttggaagacaatctgatgcacacgccagcctcaagtactgagagagtcccaatgaaaactcaaaagtttggagacagccttcccagcctactcccaagctgttctcaacattttacttgtaggaaagttgaaatttcttccttaaagtccacctaaatatctttcttgctttaatattatatatggggaaaagccacagattaggaagaagggctcaagagtaacgagatcccagctggcaattttacctgagctcaaatttccagatccaaggaaactacatcccagggccttaaagaatataaaggatggacgtgaaattattcttcataatcactgaaaaattaagggaaaccaaagaagtgtcaaaggctgtggatagacaattttcaaatcagtaaaaatatggagtatggaaaccatagacatgaaaagtttcaattttatcctaagcgttattttagaacagattattaacaaaaaaaataggaagaaatttttagaatagtgacaatttggaatcagcgttggttcaaaaatagcaaatcaggccaaagtaacctcatttctttggtttacccaagagaatgcctcctctagtaaatctagtttacataaaggtccattcagagaaatactgatttatgaattgtattcacagaaagcaattacttttcacttttttgaatacaatccacagaaaatgtttcatcttgtgactcagtacacacatacatttatatgatcgaaaaataagtttcatggaacaatatttaagtatgatgccctctcatatttgctattctattacatttgagtgtttaaaaagtgctaatcatgaccactacaagaatttcacaacccattaacaggtaacctcctctcaggagatatgctatagggctctgtgtcattctaccagtgaaggaagaattaagaagaacaaatctgtagaagataaccaagctggggaggacaagctcttagttttctttctcccaaagcagagtctgaaacaaggacttgggtgctgttgttcatttggaaggtgatcccaggaagcacagtgagaaagcaggggaaatgagaaaggaataggggaaaagcccataaagatatgctaatgagcaggttacttctgggggcaacctggattcattcccactgaggagcctctgaggaaacacaacccagggacacgaaaggttgggtatttacccacagactcctgccttttttttggctaagagctggcggggtgttacatctcctactcttccagaaattcttgctgagcgagctcccacaggactggagtaaatctaaaggcaaagcctctaagacatgtggacatctaaggtgagaaactgtcagcatgtttgagaactgtctacctcagctgcagatgaatccagagatgggcggaggggagatggcacagggcatcaacaatgttggctacagatgggcaaaaccaacagatgatgaaaccataggccatagctagtttgaaacctacaaggagaaattaaatagagattataaacatgaagtcttgtatttctctccctacactaagctgtacacccagcaagggggagagcttccctggcaggcttgggaaagagcagccagctagttgcccacattgtgagccagcaggtgaaatagtttcttaaaaaagagagagcaacagtggcctgcaagaggacagaggctaaaccaaagaagtctggcttatcctagactgaagcaaccacactggaataacagaccatttgggccaattctttttttttcctttcttttttttggacatgttataattgtacatatttatggaatacagagtgatattttgatatatgcatacaatgcataatgattaaattggggtaatttacatatctatcacctcaaatatttatcacttggggccacactttgagaaggacacagacatgccagaagatgctagaaagaaaaaacaaaaaatgaccaacagagactagctttcatagcaaataaataagtaaacaaataaataaaaagtttgttgaatggtgaataaactttagatttgtagcctgaagaaaatgggactaaaaggaaatagaatccctgtgttctgatttctcaatggtcatcccatggataaaaatagagagaaacttactttgtgcagtaccaaaagtgagaaataaggacaatggctagatgtcatgtagagctgattttagcccagtgtgaggcagggtattctaagactccaagaccatcttgagattccatcaaagcttactgaagctggaagtgttcccatgaggccgaaggatgctggcaagaggggtgagatgagggaagtagggtggggctctacagccctttccaaggttaagattatatgattctgtgaaattgtagtaccaaataatgtcttgcacacatactcaggatcaacttttacgctatgaaaaagcaacctttggggagggagtggtgtacagaaaggtggaggacaggacgaaataagactctaaaggtaagagagagaaataataaaaaggcagagtgatgaatgctcacaaaagatcatttccttagctctggagaggagaaaaggatctacggctttcaatccactaccaatcacaaacttaggtttctgccttttcccctgctgtaaaagaaatgtggggagggagaagagagaagcctcagagaataccaatttcatgtgtctcagattcaattcaaagaaagaaaaacaggaggtttcactgctgtcatttagaaaataagctacaggctatttatcacacatattgttggagccttggagcacagaaaatgataaatgatgaatccagatatgccctggcttattaggaacactcacagtgactatcaaacaagcaagcaccctggggtgggggctaagatcactgcatgattaccgctatgattctgggctgtagcaaatgcttcttttgaagtaggattctacaacactgatggtacaaacattaggcaggcgctgggaagcaaaagtatactggagagcaaaataaaaaaatgttaagaggaaaattattttttaagctggatgagaaaggtgactcgttgcataataaaggacattactaacatattaagttctggggcccgagcaacaatcagggataataccataagccactcgtaataaatattttattttttaaaaagtgcacaattcaatgaactgttataaactgaacacacccatgtaagagaactcagatcaagaaacagaacatggtcagaaacctgccactatcctgacgtctacaggctggtgcaaaagtaattgaggttttttttcattgccattggcaaaaaccgcaattacttttgcaccaacctaatgtcatcacaagttggttttggttcatatacttataaggtattgaaaaacatttgtgactgaatttaaaactttagtgtgggctgggcgcagtagctcacgcctgtaatcccagcactttgggaggccgaggcgggtggatcacgaggtcaggagatcgagaccatcctggctaacacggtgaaaccccgtctctactaaaaatacaaaaaattagccaggcgtggtggcgggcgcctgtagttccagctactcgggaggctgaggcaggagaatggcgtgaacccgggaggcggagcttgcagtgagccgagatcgcgccactgcactccagcctgggcgacagagcgagactccatctcaaaaaaataataataataattaaaaaaaataaaaaaagtgtgatatttcagaggtgagactctgggaacagcacagggtctttctagaagactagggtaaaataatggagtgaggtgctaagaatcctcatctagctctgctactagctagccatgtgactttggctagccccatcacctctcaggagccttagtttcttcctgtttaaacatggaattggtatattctattaactacttttaaaattagaatgcaggcattgcatctgagggaaagacttgattcctagagcgtgagcaggatacagatgagattagattgacaaaataacagagtggctggaaaaaaaaaaaaaggagaaaaggtctcgtataccagatttggatgctctaattgaaagcagaatggcttttagacttcaatcctgatttatattactgaagtgtttttatgagttaatgatgaattacatgtcaacactgtttattcaaaagagaagtcttcaaaagagcctattaatttgggggatttggcttttgttgatgttttgaacagaatgtagatgttaacacaaatgttttccaatcctcagtgttattgcaattaagctgaagtcaatttcagatgtctgctcaaaataagaatgtgtggctggttcatctgtgattagaaatagcttggatagaatagaaagctgagccaaacacctgagctatggccacctttcatgtgacttgtgtggctcatgggtctgctgcagaatgtgaaatcacttgtctctactgggaaataagccatataatttctcacaattcactcttttatagatgactgggtatcatttcactttttaagactgtttaatgtttgatgataccaatactagggccaaaataaaagcaatttaatgaaaagtttaacaatagcctcatctgaaagatcatcttttactgaatctccctcaactccacaatttccatttctcagactacaagcaggattgcttgttcacttttgaaataagctatctaataaagcagaagaaggacactgtcttagtccattgtctgttgttaaaataccacagaccaggtaattaataaggaggagaagtctattcagctcacagttctggaggctgaggagccccagaacagggcactggtatctggtgaggccttaatgcggcatcatctcatgaaagaagggcagaagggagtacatgagacagaaagggaaagaggaggcaaactcctcccttttatcaggaacccattcttgagataactaacaacccactcctgctataatggcattaatctattcatgaaggcagagccctaatggcccaatcacctcttaaaggtcccctgttaatactgttactacagcaattaaatctcaacatgacttttggaggggacaaacattcaaaccacagtaaacatacagcatttgatgcctaatcattctgcattgttaggttcctttcattattaacatatttattgatattagctcattttaaaaaggctttcaaaaatgagctaatgtcaataaatacgtttttggatgggactgaatttacttaaaggaacaaatgtaacatatttgttcctggtacaaatatatcattcctctgaactttcacagtgactctataagactattactccccactttttagatcgtgattttttcttctctcatcctagtagatatatctttagaaaacaaagtgttttccaatgataaacaatccaatcctttctctaaattgtaataactataaaacctcacacaaaagacttttcaccatctgcaacagtcaaaagttatttatccaggtctaacaatatactaggcatcatagtgaagaaaaagtagaaaataaagaaaagaagaaacaaagggagaaagaaagaaggaagggaggaagaaaaccacctgactaccatgaaaaggataatgtaatgttaaaaaaaaaaaggtcacaatattccaattctgggtaagatgcagtaatcgtacttcaccctgtctttcctactgaatgcagctgaaaaacctgaacaaagtgcatctgaacagctctttggtgattctgaaaaagtaaacattagcaggcagactaagaatttggggccgggcatggtggctcacgcctgtaatcccaacactttgggaggccgaggtgggcagatcacgaggtcaggagatcgagaccacggtgaaaccccgtctctactaaaaatacaaaaaattagcgaggtgcggtggtgggtgcctatagtcccagctactcgggaggctgaggcaggagaatggtgtgaacccaggaggcggagcttgcagtgagctgagatcacgccactgcactccagcctgggtgacagagcgagactccgtctcaaaaaaaaaaaaaaaaaagaatttggggtaacactgaattggtgttgctctggtatcccaggactagactaaaatcagcccaaacacagaagtagacactgggtacagagagagttccaggagaagccctctatctctgactctaagagtggaaaagaagaactgtaatgcttcagagagaatgaagaaaattccctggttttcttttatgttcattttctccattatttcatgacccagcccccatataaccctgtggtgacagtgggcaggagtgacagcagtggcgactacagcaattgtatagcaaactctagatacctaaaactctgggaatggagatttttttctctgtagagaagatgtggtcttaagagggtaggaagactccttgtgactttttgtctttcttggtcttccccttgctcaataaactttttttttcaatcttctttttaatcttggttttttcagggagctgtgggacaatatccatatgtttaacatttcagtcaatagagttcaaaaaggagaggagagagagtacagtgagtgggataaaacagttctcagaggggaatttacagcatcagatgtttatattagaaaaaggaaaaggcctcaaaacaataccttaagcttccactttaagaaactacagaacaaaacaaacccaaagcatgcagcaggacataataaaaataataaaggcaaaagtagaaattaatgaaacaacacaatggaaacaatcaaaccaaaagctgttttttgaaaatattcatatcattgacaaaactcaagcaagactgacaaagaaaaacaaagaaaagaaacaaattaccaatattaggaatgaaacagagggtatcacagcagatactgtgtataactctacacataactttgacagcttagatgaaatgaaccaattcttcaaaaagcacgaactatcaaaactcactcaagatgaatagataatcttcctaaaaataaatctccaggcacagtgatttcactggtgaattctatcaaatatttttaaaagaattctacagaatgtcttccacaaaattgaagtggagaacacatgtcccaactcattttacaaggctagcattactctgatgccaaaaccagataaggacttcacatcaaaataaaactacaggacaatatcagtcatgaacacagatgcaaaaatccccaacaaagtattaccaaataaaacacaacactacataaaaagaataatatggtaacaccaaatggtacgtatcctgacagtggaagcctagcttaatattcaaaaatcaattaatcaatgcaacccatgacattaacaaactaaagaagaaaatccagatgatcatatcaattaatacagaaaaggaatttaacgaaatttaacatccattcgtgatttaaaaaaaaaaattacagcaatctaggaagagaagagaatgtcttcaacctgatgaaggggatctacagaaagcccacaattaacattatactttacgatgaaagactgaggtgctttccccctaagactgggaacaacacaacactcaatttcactaccctattcagcactatacaggtaatcctagccagtgcaataagacaagaaagaaagaaaagatacaaagattggaaaggaagaaataaacctgtctctggccaggcccggtagctcacgcctgtaatcccagcactttgggaggctgaggcgagtggatcacctgaggtgaggagttcaagaccagcctggccaatgtggtgaaaccacatctctactaaaaatacagaaattagccaggcatggtggtgcacacctgtagttccagctactcaggaggctgaggtggaagaatcacttgaacctgggaggtggaggttgcagtgtgccgagattgtgccactgcattccagcctgcgcaacaaaaggagagaagaaagaaagaaaggaaggaaggcaggaaggaagaaaggaaaaacctgtccctattcacagatgacatgattgtctatgtagaaaatctcaaagaatcgacaaaataacacttgaggttagcaatatcacaagatacaaagtcaaaccacaaaaatcaattgtatttctatatacttgcaataaactattagagaggaaagttaagaaaataaaaacatttccagtagccccataaaatgaaatacttataaatctaacaaaacatgtatgggatctgtatactgaaaactaaaaaatgtttgtgaaagaaatcaactaatatctaaataaatggagagatgtaccatattcatggattgaaagattcaaatattaaggatatcaattctcccccaaactgatcagtaggtgtgacataattgccatcagaatactagcaaggttttgcagatataaacaaactgatcctaaaatttatatgaaatttatagccaaaacaattttggaaagaagaataaagttagaggaatcacactacccaattttaagacatattacaaaactacagtaatcaagacagtattggtattagtgaagaaataagcacataaaccaatggatcagaataaagaacccagaaacagatctgtacaaaaatttccaattaatttttgaaaatggtatgaaagcaattcagtacagtttattacatggcaagtacacctcaagtaaaaagtcgtttttaaaaaccctgtgtgttcttctcacaattttttttattccagaaatttcaggaatgttcaatgcatgaagaggggcctttgggattcacaaaagtgggaaattatttggcgttcatccaagcttttttttcccctaaatttagaaactagatgaaaactgttctgttacttctcatgtaatcagtatccttattaagcactcagcattgaatttaacattaggtcttgagaagaataatatatgataatatgaagtaatacatttcaaactttaccattgcttacaaatgaattcaaagaaaaacatcaaagtcaaagtacatttcttacatatcaatagtaccaaagaagactaaaagccctctgttacaggctcaaatgatgcaagttccttgaaatgaaaggacatcaggacacttgagggcagaacaagtaggcagtgggagatttttttagggaggcctaaaaaccagcctggtttggaaaagcatggtaggagacacccacgtccacttgagcttacagtaaatgatctgcctcaaattgccagtggccagtggttacttaacggccatggctagcaatttgcgggtgtctgtcacataaagtccagtgagagagacagagaaaatggctagtcagccctctacaaggagcagaaatgtgtgcaagttgttttgtgggaggtataaccataccttacatttgcactgtatattacaaatcacttccctaaaagagcaggtggctttgttcacagttggcagacgaaagcagaagttgcctgagtttaatccagttagcaggtggataataatattgaacatctttggtttaagtatctgttcaaatattttgtctgctttaaaaattaggtggctttttttcttgttattgagtttagagagttctttatatatttctttttactctcttagtggggtctttggaagagaagtttttaatttgaataaagtaaaatttatcaattataccttttatagaccatgcttttggtgtcatattcaagaaatctctgcctaactcaagttcacaaagattttctcccatgttgtcatcaagaagtttcatatttataggctttatatttaggtctatgatctattttgagttcatttttgtttaataaagtctttgtctttgatagtatcaataaccattggaaaatgagcctttgatattcccagggatgctgatttactcacttctatgaactttcaatgaatctgcatatgccacattctgtagctaaacagcctaatacacttggctagcaacctgaggtccagcatctaatcagaaggcacccagcaaacatcctggaaaattaaactcccatctccaatatgccgtcccaaaccagctctgtagtggattgcctgcacagtggccaccgacaattcctcccaccctgcacatgcatataagaggtagactccatccactaccaccaccatcccaaatatgggcctgccttgtgattttctttgactaatagaatgtaacagaagtgatgctgtgacaattctggatctatgccttaagtgtcctggtagctttggcttttgtccactgggaggccagctgcatgtaatgccagcttcctgctggagagtaaggcaacacggggagatggaaaagagctaaactatgcagactgcagagaggcagagagagggaccagccatcccagcgatttcagtcatcccagatgaagtgtcagacacagacacatgagtggaaccatcccggatcctctagacccagatgagtcaccccagacaacaccatgtgaaccagagatgagccgtcccccaaagtcctgcccaaactgcgggatcatgagtaaatacatagttgtcacttatttaaaccactaagttttggagtggtttcttatgcatcaaaagataagtgaaacaacctccaagtgtccatcacagaagccttctttacagttcattcagtgacctagagagttctattcagcaggagtcaattcagcagtacaaagaactctggaccagaaaccaaaatcctgggttaagttccagcttagccattgtctgagttcccccaaaagcacactctaagacaaagtacaagtagttcatttgggaagcaatcccaggaagcatagcgatggactagagcagagagacagcgaagagaagaaagacaataagggtactgctcactgggcaactgctgtgagtcactgttgtgggcaattggggctccatcctgctggggactcttcctccctctctggcatccaaatactaccgttacataacttctttccccattgaggctacacttaaatgttcattttaactttatttcatccagaaataaatggcagtagaatggctggctggtgagagaatgatccctgccagacatgagctctcagagacagccttgcttccacagctgtttcatcagaggcaatattagacaatattccatcctcttattcaaactcttctatgcagaccccaaaaggaagaccctaggcagagtccatggcacccataatccccaggccctctgtctttcattagcaaagacaattaaaacagcatgtggcttgtgaaatatcaattgtggtcctactttacagagccaacaaaaataaacttaaaagaaaagctttataaatgaaggcattactctggtccaaggggaaaataatatttttccaatttagtctccttctattgtttaatactacgaagggccaaagtgtgtccctgcccattgcccagagatgggagagaggagaaacagaaaaaagacaaacacctaaatctgaggaggtcagcccaaagcaggggacctcaataaatgccaagtcctgttctcaccaaggggcattcacaaagctctgtagcctgactgtccccagtcaacacagacagacaaaaagagggctagcctttaaagtaaaaccagacagtggaacaaaagcaatttgtgatgtggcatgtggtccttcaaatgcttaactctcctctatagaggtcaaatgggacacagagaaaatctaagaaaggaaaggaggatgcagtaagactttcagcagaagactccagaccaagacactggcggaggccacatggcctcagagagctatgagcatgggagggatacactgagctggagaagagctctctcttgcatcaagttcacatttgagggttatcaaattgcctctgttccctggcaaaggagatgattccactcctttacaatttggttcagaaggcaaaaacaaatcaagaacccatccatccacatcagctcttgaggcttcaactccatttaaacaaagacagagtaaagatccaggcaagactatttcaaaggcctaccccatgttctgaacacctgcccaatagaacagtctgcaaacttttaaaacagtgtttttcaatgtgggcgctatgggcattctaagggagccaattctttattgtgtaggcctggccttctctatcattatgacaacccaaatcactaccatatatttccaaagttcccataggcaatggcatggaaatttaacaaagacatcttaaatccatttatgccccgcccacacatacatttgtgggtatttttttctttataattgaggtaaacatatatagtaaagtgcacaaatcttaagtgtatacagctcaatacattctatgtatgtgcatacccatgagacctcccaacccagatcaagatacagaatactgctggcacccttgaagacccccttgtggcccctcccagtggctaccccataaagacaactgctattctgacttgtaacaccatggactagttttgcacattgttgttgaactttgtagaaatggaattgccatatgtactcttttgtgtctggtttatttcactgaacattatgtatgagattcatccctgttgttacatgtagcaatacattccttttttaccttttttgtttaagaatcgtaagcacagaaaagtgtccagaagtttatatcaaactactgagtggcaatttcagaaaaagagaatggaatcaagaggaaaatgaagggtgggcctgctttcaactttttatgcctctatttgaatattttcataatgagcatgttttacttttataattttattttaaagaaagggactcactctatcacccagtctgcagtgcagtgcatgatcatggctcactgcagccttgaccacctgggttcaagcgatcctcccacctcagcccctgagtagccgggactacaggtgagtgccagcacacctgactaatttctttttttttttttttttttttagagatagggtcccaagatgttgcccaggctggtctcaaactcctgggctcaagagattctctcgcctaggcctctcaaagtgctgggattacaggtgtgagccactgtgctcagcctatatatatatatattttttttttgcaaaaaattttggaaaaaaagtggtcagcctacaatttttgaaagccttgttaaagtacattcatcagaggatactttcagctcatctgcaatatcagatgggccattttatagatatgtgtagcattcagaccaccaagccaagaaaagtaaacgataatatctattttctgcccaccaaaaacatagaaatggaagttgtcagttgtctcatctattttcactgaaaatcaaggtctgcatggctttctcaaccctcattcctctcctcagcggccagcccatggaggaagtagaataacttagtgcttcctcccaactcaccctcaagcctcactatcactgagaatttcaaactaagtgacaacacagcagttacatatcctcacagagtaaacactaaaaagtgttcacacacagacccatggctgtgacaccactagccatggaaggcaaaggaagaaggtctggaatgggagggagtgagctgagctttgagaaggaagacacagcctcctcatgctgagagccatagcttccctcctatctgaatgtgtcctgaggcttcccatggagaaaagggtcactcactcaaatgaaagccatttggacttggctggcctgaaaagatgagtttggaatttggatgaggaaattttacagaagaaagtattctgaaaggaagtaacgtgaagaggagagagaaacaccccaagggctgttccccagctttctttacatttgaatacacaaaaacacattttaaagaacacatgttggcaacacccaaaagttggtggctttcgtctcaaaaaaacttcctttaaccaagacacaattgctagagagacagatgtgggacagatgatgctacccaaaggttggggttttttttcttccccacttccacctccccaagcctgcagtggtcactgccaccagtaaatgcttcaggaaaaattcaatgtcatgttcccaaatgtcctgtcctgaaaccaaaaacacagtgttcactgaaatcaacaaatgtgaaacactaggctagtgagatgttcggagaaaaccatttggaaacgtccacaccagtggttctcacacttgagtgtacataagaatcatttggaggatctgctaaaatacagatggctaggcccacttcccacatacccagcttgtgattcagtagctctggggtgtggtctgagaatgtatatatctactaggttcccaggagatgctgctgctgttgctgctggtctacagaccccactttgagattctgtggtcctcactattcctccttgtcctctctcagagagtaacaaggtatactggcatatcaatgaccctgagcagtcctgcaataaagaaacctatttaacccagccttttgcaactaaattacagtgcatcctgcttcccatataccatttctgaatgtctctgggaagcagtgcttcatggaaggaagtaggagacggtggagagctatgggccatactacataccaagatcctggcagggcagcacatctggagactgctgtctagaaatccaggaagcattaagaaatatgtcagcaggtagcaaaagccagtccacctccagcctcagattaggacactggatcctagccaagaattggcaagaataaaacagcaacctagtttttagagcatctaagatatcaggaggctaccaagcctcaaaccttgagaatgagacacccagttatgtgtcagataaattaaccgtatacaaggctagttatagcatgctggcctggacctccaagatgagtcctgagctgagcctcgtggtggggaagaagtagccccaaacacccaggaatcttgttaaaaggtaggtgcttatttcatatctgtgatggtgttcaagattctacatttctataaagctcccaggtgaggctggttatcaaaccacactttgagtaaggccttggattaggggttcggcaaacattttctgtaaaggaaaatatttcagctttgcaggccatatggactctgtcacaactattcaactgccatcgtatcaccaagtagccatagacaaatacccaaaggaatgaacatggctgtgttccaataacatcaaaatttgaattttatatcattttcatttgtcacaaaacattattattcttttgattttttttcaatcagtttaaaatgttaaaaccattcttagctcaactaatcatataaaaactggcagtgagccatctttggcctgcctggactttgtttgcagaccttcaccctagattactggtccctaacctagatctaccaaatcaaaatacacagaggcggagccagggaaaccatatttcatcagactccccaggtgatccttactcagcctgtacaaataccattgctggccagacacggtggctcacgcctgtaatcccaacactttgggaggccgaggagggcagatcatgaggtcaggagtttgagaccagcctggccaacatggtgaaaccccatctatactaaaaacacaaaaattagataggtgtggtggtacgcgcctgtaatcccagctactcgggaggctgaggcaggagaatctcttgaaccttggaggtggaggttgcagtgagccgagatcatgtcactgcattccagcctgggtgacagagcaagactcggtcaaaaaaaaaagaggaaaagaacagagaaaaaaaataccattgctgggttggaaactactacttacccaactccctgaaaaggtgagagaccctctttaagtgctgttaacagttcagtcttcctgacatccccaattcatggagcttgaggggcttaatgtgaggggctgtgtgttttcctgactaacccactggtctcactctcactcatctcccaaggtgctgcctccccgctaaccccagtgtcattgatttctggtatgaagataagaagtccctgtgtctttaagagctgatcagttccaggaattctcagccccaggagtcttgccggagtggcaggagcggccctgatcacactagcctggttttcttgacagctaaagttattcatcaggtattaatacatcttagctgcaggaaaaagccatgcaaggcccctgttaccaatcagcctgaagatgtgctttgctgctgctcaaggctaagccaggcaggggctgtattcctggcagaaaggcttaaaaggagatgaagccaagggaggttgcatttgtttttgagttagagaagggaggaaaaacctaacctacaggctgtacatgcttatctcaggaatgctggggacttaggaaaggaaggtcagaggattcagtgatgaaggcaaagccaacaggaaaagggagaggaggggaagtgaaccattgtgtgtcagttataaacaggcaagccactctgtcttggccaagggctgaactcattcatcagaccagtacttcctaaatttcatcatgtagaagaatcattggaaggatcttgttaaaatgaagatgctgattcagtaggtcttgggtttgggcctgagcttctgcaattttaacgtgctcccaggtgacccaagagttcaccacagatgctgctggcatgcaagcacagctttctgttttgttattttacagagtcacaagctctaaaagaatatggggtccatagcttgtccacttggagttaagctactgacatccaggactacatagatatagttcagggagttccctgcactacagcacccaccgtcacaccctcaaaaagagcaagtggggtctcaaatcaagcctgtcctccactctccaagtcttgaatccttggactcaaggcctcaagtccttgagtcttgggcctgcctctatccttttcttgcccaaagtctgtctcctgaccaagccctgtgtccacagatctacatgtggccagatgggggcctctttttctaattcacccaaaggtgctttatgcaccagtggtggccctgcagccagcattgagaggtggccaggcaccattggctgactctggctagtatcctgccacagttgaaccttgaaagcactatactaagtgaaagaagccaaacacaaaatgataaatactgtgtaattccatttttatggaaggtcaattgtaggcaaatctatagaggcagaaaatagattagtggttgcctagggatgggggattaagaaatgatggctaaggtttggagtttatttggggggcaatgaaaacattctaaaattggttgtggtgatgaatgcacaactctgtgaatattctaagaccattgaattgtacagtttaaatgaatgaggtatggtacatgaattgtatctcaataaaactgttatgaatttaatcacaaatcagttggggagctcaaagcaaatggtatagagaggaagcatttgggactctgacaacctcaaaagagggcaaggactgacactgaggcagcaacttctcagaactcttgaaaaacatccaaacagctctagatatgagatgctgagagtacagccaagtgtcaatataaagaatagccctgagatacaccctggacaggggctcagtgaacaatgctgtattcgtccatttttgcactgctatgaagaaatacttgagactgggtaatttataaagaaaagaggtttaactggatcacggttctgcaggttgtacaggaagtatagtagcttctacctctgaggaggcctcaggaaacttgcaatcaaggcagaaggcgaaggagaagcaggcatgtcttacatggccagagcaggagcgagagagaggaaggaggtgctacacactttgaaaacaaccaggtattatggtaacttactattgcaaaaataacaccaaaggggatggtgctaaaccattcatgagaaatccgccccccatgatccaatcacctccagccaggcccacctccagcactgaagattacatttcaacatgagatttgggtggggacacagatccaaaccatatcaaatgctcagtgccattcattcttgcctgcctatctctggttccccacaggatgcctgacatgtagggatcactcaaaaattgaattcaatgcatgcctatgaagtgaaaggaattctatagccactagactgaggtctactcccaactctgcatttaactctctgtgtgaccccagacaaatcccttcaacttgctaagcctcagaggctcctccctaaaatgcagggcaagttaccatctcaggcatcctcccagtctgaggttccgtggttccatgaattaggcaacccatgcaagggagcctgggtgtggaacagagaaactcctgcagaaatctagataaagaccaagacacccacccagaggctcagaactggccagaggcatgccccccagcacatgtcactccacagatccactgagagcctcccagaagtcaggctccctgctagaccatgagaatacaaaaatgaacaagatcccacaacctactcacgtggctgggggcatcagctccgtgaataggtaatggtgcaacacaatgaccctactccttggaaagctgaattaaaatctaagtggaaacaaaatttcagtgttggggattgaaaggaattggagccttgatctgactaacactgagtcagtaccaacatgtctgtcagagttcctataaggaattgccactttgtgggcagaatctcaggaggtggaggatgtagccgctccaccgcttcctcaccactccacaatgggcctgccaaaccttggcttaattctcaccctgtggccctaatttaaccgtgtttgcgaacaatcttggatcactgggattggcagggtcattcagctcagccacccacacaataagcggcaggcgagcgtcatccattagcagatcatggggtgtaatcagcattgaggagattctcattaagtactactggatgtacattgcaaacagctagtgatagcaggggaaatgagctgctagtacatgtgactacactacaggtcactgtaagagtgggacagaagaaatattgcaatgatatttcaaggccaaggcagaaagtctgtccccagattctatgtttggatctattactcagaagaaagtttgaaaatcattatgctcaatttacaaccccaaacctctgggataatccaagccattatgtccaaacccatttatcttctccctggagaacaatgcataaagaagcatccattgtgagctaaggattacgggtgagtgaatcattcagctcgggaatgagtactccagaggtttctgaggtcagaatgtgccagacacccgtaagatccaggtgctaccaattatcatctggaaaacttgggagcttagcagtgctaccaaggacttttctcttgcacaagcttttcctctaaatctttatctgcacatcctgcccccagaactcccttgagtttctaagtctcttagaatgtcttacggtgatttgacatccaagagccttcgcaattaactatgccctgattcgttgcctgtccaaatggacaaatttcctttgacatttagctatcttgcaatccgttttctcaggaaagtgtcatcttggaaattctggttaaatcctacaggggagatttgaaatggaatactttgattcacaattacttcaatcaattaatccacaaatactgactaaagatcctcccccaagtcacactgtgtactaagtggggcaggggggtacagcaagttaccagcccaggcctgaaggcaattacaatttacgattacatctgttttgcttggtactgctttttaaatgaaaataactggaaactatacagctggctgtaactggaaaggccacctgctcactggttcaatcaaagtttacctactgtggtaatttcatcttactctgtatgttgatttttctgcccattaagtgcatattttctcatagaattcatgaaggtgctctagtaactagtggttttgaatcgggatagagccgtctccccagaaaaaggacactcacacagatttttgtctccaatttcaaaacattcttagagaagcccacacatcctctactttcacttttcttgggcctttagtgccaccatctccgcaccagcaagtctcagcatcattcttcaataaccaattccagtgttcccacatagctcctctctgtgctccccgggcctgtcaatccaattgtattataacattgaccacctgaaataactatgtctctatttccccacaagacagaaagctacgagagagaagaaattgcataccttcttcatcgtggtctcccaagcacataaatgcttcatcattcagtgttcactttaaaaataagtctctgggcagagcccaggatttattagaaaaggtagaaactgattctatttcagaactaaacccaaatttcccagagattcaggcttaaaagaccaccctcctaaaacaaatggcccataaaagttagcagttaagacatcacacagtcaagaactgaggggctggtttgagaaactccctatgaattggaagttgggagaggttattattcacgctgctattttggaagcgaatctctaacctgggcattaatcataacttgcctgctacaaatttcatactatgttatagcctggcaaaactaaaccttcttctgttcaaattctctcttcactttcaattactaatttcagttgtgttctctgaaaggggaattgacgtagcacacatatttgcgtttactaaggaaaccattcaaccacttgggaaaggcacagatcaaggtggccaacaaaaataataaatgcaaactccagcttgcggttgcagtcagtctctcatcttacagcccccaacagagaaggttattgcttaaacagagagtgttcgtatatttaaaaggaacctctgtatccagtaagccatcgtttctatgtatgtagattcatggtggcacaaagccctgtgtacctgtgcacatgtttccctcagctcctttcctgtccaatggcccatcactggagttacaggcactgttaatccattacgcacaaatatccatgtggcacaaagtgctctgctaggcaccgtgggaaatacaaataagggtaagacatagcacggcccctgcctccaaggtcttaaaatctacaagaagaagagtgcataaattatgataatatacagcattatcaaatatgtgatatatgtgataaatataagagacatgagtgagaccatgggtgttaaaaggaaggcacgttgcttcccattggagcgatcaagaaaaggtctcatcaaagtgggggtgttgctggatgatgggcagaatttggacaaatggcaagggggaaggattccaggtacagaaagcagcatctgccaagaaggaaaatgtgactcaggttctataaggataggattttaggaaaccagggggaaaagactggaaaattaggctagaagcaaactgtgtagccccctaaaaacaactgagaactttttacttgagtgagaacagggacctgctgccctaagtttttgagtaagggagtgatgtgataaaaaacagtactaaagtcaatggacttaaaagaccattatctaaagtgagaaagtaaaatgagctagaattagagagaccaaaagtgagaatgttatagcaataatctaaaagagaaaagcagcactttggttatggtacgaggactgatgaggtgggaagatgtgaagacgctgctttaacaatggtttctggtgtctcattcagctcccaaatctgcgaaatgagtagtaactaacaaacaacattgtactgtactgaaagtgttatcaatgaagaaaatgccagaggaaaatgacctgctctccccagcatatttccttttcattgcagagtacttttgtcagctgattacatgttttaaatctaaataggaattcctagcctgttcccggtgacaccttaattatataacctgagctaggtgctccattcctagtacttatctccaaatgtggtatttcaaaagactgcttcagctgatgtagtctggtttggcttttagcaaacctcacttggttttcctgactagtaaaaccacgctactttaccagttttctccagatgtaagattcacgaagcctttcttagaggccatggtactcattctccatcttcagccttgtttgcagaaggaggcagagtgaaccaccactatctcacatgcaaatacagctctaagaattattttaagaacagaatctaaattctcatctgttataagcatacaaacacagtcaaacacaaacaacttttctacaaattttccatacacttcatgtaggtttttatagacactgcatctttgctaggctgcaaaaaatagatcagagagccagaaaagctgcattaaattctaagatggaagaactccagagaccttctaggagtgggaatgagaatgatttactctcactctgacagatgtgctattcacgtgcagatagttacataatcgacttgctgatggagccctagatctccatcttctttcagaagttccagattcaagtccttcactttctctcttactgaagatatgatgtccacttgctaagagagtgtctctgaaatgatctttaaaatttgtcacccagcacttagagtgaactcagcctatgtgatttgctttcagacccaagggcctagagattttcccctccccagccttccaaagcctctggcttggactgaaatcccctcctctggatctcacaacctcagcggagcacacttcccaagagaccccattgagccatgccaaaaggaggctcaagaggagtgtttatcaagcagctccaatcagcttcagctcatttgtggtctgagcagagccggagggcaggttaggagtcagtggaggtggtggcaagcaggaacatggtggctaaaagttgggagcagcttgcaggctggcagagggagccaggaaagccagggataggtcccaaaagacaggtggtagtgaatgcccaaactggcgaactcatgattctgtggctgggccctggtagcaagctgtactatataaaggtggaagatgagagaaaggagaggggagggcaggggaggagaacggagggaggtcggatggaaaaggagaaggggtccccagcttgagaaaggctcaactaaaagttgaggttcccaggcagctcacaggcacctcccaactcagtgcggaaaagctacctctagcttctcaccttatttgcccgctcccagaaagctgcttctgggacgcttaatgacttcctcttcccctacaggttcattttaacctgattcctgctaaagggggtgggagaggaggtattaacacaccatgggaataacagttgcctggcagtaaggataaaatttcctttccactttaccctgaatcagttcctacaaagcagcttaaaacttaagagtcagctcaaaacacaaatgttcctgtttattaatttacaaatttgttctattcattcatttatttaggtgcgtgcagagaatttcccgcagccatccctacatctcccaagcacactgctagaaagatgggcatcctctatccttctaccagaactcagtaggttcatttctcataccctagatttaagctgcccacggtgttgaacgcagagccaaatatttgcacgccctatagccgacgtcacccactttcccattaacactaaattaaaacgcatccatggatttcctctccattccgaggcaacaggagtgcatggcacattgccctactcccctgaagctcttcgctaacctaagactccagggtgaggaagttagctggagctttttaaagtgcatctccaaagagaattttgctcacaccatgagagcccccaagaaacaccagggcccccttagatgccggagaccacgccctccaggaataagccgcaccctctgcccagcagatccttgcgcgagtagccctctttccctggggctaatcaagtgcatgccacatgtcaccactctcagctggcaattcttcctcagaggcgcagactttctcggaatccccagcagggggggttaagagattcaggggaggccccgcccgtgccttccacaaaagtcgctttaccgtggctcgtgtcctgcggccccaagggggtagcctgggacgtgtagtgggagggcatagaggctccttccaggacaagctgccagcctccagtgggcaaccatgtgagaggcaaaattctgggggtgagaaagtagcaaactagtctgcggccaaactttctctgtggagcctcctacaccgaaaagggtttgattggaactctggaagcccggacgcagaaggtgctagggctcccgtcgccgcgagggcgccccgcgcctggagatgggatggtcagttcttcccggcgcgtgcccagacaccagccccgatccgcatcatccccaccctcgggctgcgaaagaggagttctgcgcaaacaaagggcgcccccggcacctccctctatcccgagcgaagggtcccaacggcgactccgggggtctttggtgcccagctgaggaggcagccacgcctccgatcctacctgggaagctgcggctgggcgggacgcgcagcagcagcagcagcagcagaggcggcagcagcagcagcagcgcgggccgatgtgcggggctccccatggcgagcgggcgcttagctcgcctcggcagcgcagcgcgcttcccgggggcggcaggagaccgaagagaccaagggactgcgtgctagcgggcgggcgaaggccgggctggaaaactcctcctctcgcctctttccctccctccttcctgcctggggcctgccctcctttctccgccccccctggaacactgcgcggttcggggctctgacccacccacctcctccttttgtgccagcgctttttctggccagagagcgctggagacaagccccagcagagcgaaatatcctgaagtagctttctttgccccaatttgcgcgccccctcacccggaatacacacacggtattcaatacaaccgcctcgaacatcccagacgtctagaaggataccatctgtgcagaaagctgcgtgagtcacacggaaacagaaggggcaaccgaggggattcagagtggcccactgcggccggatactatggccatgttctctgttttgatcctcacgaccatgccccaagttcgctattaccatgtccactttctccaataagacaccgacgcttagaaacttgcccagattcacccccgttactggcagagcagggactggaacttaggtgtgtagttctgccgacgtcaaagtccatactacagattttttgttagtttgtttctcttttgcaaaggaataaatcaaggactggaccgggtgcgtgcctgctctgctgcggtttaggatggggcttgaggttctccttccaggatcagctgatgggagagcacaaggcacagaaagttctctgtctcacccacagccatggggatccagctgtaggttcctgcagccagatttcctcatttcctgggttgttctcaaccaccccaaagataccacgaccagactggagcctcttccctgtggcttggcatcgctggatcctggcatcaggacagggtttctaggctgcccgcaggacggatctggtttctttgaggcatttgagtaagcctctcatagttttgtttgtttgtttgttgttttggttgtttagttcttgttaaatcagtaaggcaatacgttgcccctttgctgtctcagaaagatcttagctaaggcaaattttagttggagttgctgcattaggttgtgcagtttgggcactgtacaaaggcatccagaggaaggggcaagtgggagccaaaatccaaatgcctttgggttcagggagctttgcgtcttggcaggggccacatccactagaagggcatctttctctctgccacagtagtctggtctgatagctaggctaagagccctgggggcactcacctagaagttctgaatttgtttatccagaaggagtgccatttcccaattctcacaaaagccccagacttgaacgtccatcttaccctctctagcacttggggggacttcgctccatctcctgtgggtttctccactgctgctacctcttcagggaaccaacaacccttaaataaccccctagtcgcaaggaaatgggggaggtcagtctattctgtggcctccatcagaccagactttccagggagtcattctcaaccttgtttatgtgggtcacctggggagcttcatgaaaataccatatccaggctctacctcacactaataaaatcagaatctttaggaatgtgacctggagtttgaccagatgcatatttttgtctctccccaatccgctaagctccacggtataagttttagtataggataaaaattctagaccaggagtttctcaacttgggcactattgatatttggggctagatgattctttcttggggagggggactgccttgcacgttgagagatgcatcgatggcctctatgcaacagataccactagcaatccccctttccccagttatggcagccaaaaaaatgtctccagacattgccaaatgtcccccaggggaaaaatgcccccaatagagaactacttctttaggtctgtaaacaagggttaatgtgcaccccaaattccaggtccaggatagcctggccagcagccttcctttcctatgtcacctctgaagcaatgtgtcttcaccacaaccagtatacattctattactgggctgagaaggaacttctagctcacttctatccactgattctggctggattacaagaaacaccacacttactgttgacttgctctctggcctttgaatgtcctcaccacaaagaaagaaatcagaaatggatgaggtgatggtcacgcaaaatactgacttgacgcttggtgcagtggctcatgattgtaatcccagcactttgggaggccaaggtaggcggatcacttgaggtcaagagtttgagaccagcctggccaatatagtgaaaccccatctctactaaaaatacaaaaattagccgggagtggtggcacacacctgtagtcccagctactcgggaggccaaggcaggagaatcacttgaacctgggaggcagaggttgtgccactgcactccagactgggcaacagagctagactccatctcaaaaaaaaaaatactgacttgattttttctttttctttttcttttctttctttcttttttttttttttctttgacagggtcttattctgaatttgaatttgtttatccagaaggagtgctgtttcctggctggagtgcagtggcatgatcatagctcattgcagcctcaaacacctgtgctcaagcaattctcctgcctcagcttcctgagtagctaggactacaagcatgtgccaccatggccagctaagtgttttttgtagatatgggggtcccataaatatgtacatttacaatgtgtccattaaaaaaataaacaaaaataaaagacttgaagaaacatctctatataatgtttacagagaaaaataacatttgttgttttcattgtgcaaggatatcttgaaggacagatccaagttcagttgcctcttgtatcaataaatcgaaataaccctttcatttttacctaacaaagataaaggggagagaacaaggtggtattcttacctagtgggaatactaaaaggaatgccattgttgtcaaaatgtataaggtatataaatcacgtgggttagagtaatagggaacacaattagatataatattgggaaaccattatttttccttgacaagcttgaagtattcgatataaacccttggaagaactaatatgaacatgaaaaaataaaataagagcctggaatgaggaaaaaaagtctcttgctctcttttctaccctatagagaaaattccaatgggacttttatttttcttattatttttattccagttttctctctgatagaagagatgagggtagaggtaaggtagaggaagaggttgtcaattcatcccaatcccacaatatcttggaagacaatcagatagttaaatagattcataatctgtcaaataacttaagggttaatgagttgatgaaaacaaagagaagtcactcagggagtgccacagagctatgacaccattcctatcctgcttgatgttactatttatgaactagaaaaagatatttttggcaaaggacatgaagataggagggcaagaaacagattccaaacatctctctaggcaggcatgctgtattgaaacattaaaagacagcaaggataaatatgatgtcctatgttagatctcaaaaaccaatcacacatgaagaatctaagaatcactagaaagccaagtagtctccccactgcatcaggctcatctgtgcaaagaagtgtttataaggttttattcagcattgctcatagtaacaaaaggttggtgacatttttgtaaatgtaaatatccattaatggggaattattttattaattatgcatacctatgtaacgaaatactatgtggccattaaaaagaatgaacaagatgcatatgcatcagtaggaaaggtagtctcacatattttgtttaatgaaataacaagcaaaataatacacatatcttgctaccatttgtggtatggggaaggcatgatactgtatcagggtatggggaagtcagtaggagaaataattttttattactgtacaatcctttgtactgtttaaatatgtaagcatgtaatgatatttcttatttaaattaaacagatcattgaaaatgttttcttaaaaaaaaaaatcacaccgatacagagtaggagttgccagtagtggcttcacagtacaacctacgacagtgcaatctatttgcctataagctaagtctccaaggcacctcaggtgcatgcagacagtgtctgtcttgtcatctgaagcattcctgagtactgggcaaagtaccagaggtgagaagaagagaacacagacatcaaagtctggcaggaggagggaggtatctttccactctgtgcagtgttgaggaggttgtagtcaacaaaacagtcttgtcccctgagtcagagcagagtgagccccaggagacaaggaaggaaaaggattctcaagagtcacctccctgcccccaactttcttccttgagcttgtcgactcagagacagcattgaaagagaccctggcagccatctacgtactgcaggagaggtattttctaagaatcaaagccccgttatgcccctcccattttcccatgcctcctcattctcccagccctctcaagctgttgccggaaaagggatccccaagaatgggttcttggatcttcagcaggaaagagttaaaaggaagtcgcagagtacagtgagaagagacagtttataaaaagctactcagttacagattagggtgtcctcagaaatcaagaagaggaatgcctcatctttgttttaagtttttcttgtttaggggtcttatctatgtaaaagctaagctaagttatgtctacatgtgggtgggctgaaagtatgacaaaatgtattacttcgctgatttaaataaaactatccttggcacttaggatgccaaggataaatacatcttaaataaatacatcataattggcataaatacaccaaagcaatactataaatacataaaagcataaataaataaatacatcataattgacataagtacattaaagcataactataatgaacttgaaatcatatactgttatggatattgggacatagggatactctgttgctgtaggaatatgtccttgcagatatcattaagctgtttctttaaatataaacatgaccatgggtcatgactggcaaggaatgtgccttgttagtctcaagatggaggttaacttaaaatggcattagtctggctttcctactctacttctgcttccctaataaacccagttcttttctttctgtatcctttcacagtaaagtgatggaagtttaaggggaaatgtggtggctcactgtaccttgggaaatggattgccagtagagtaaaagtcaaagagatatttaggagtgcttcattctaaggcagttcttctcaaactacctgtggcaaaggactttttttttttttaatgtccaatccatcattgatccatgctttggtaaaatcagtaaagatgactaagtagaaaaataaaagagaaaacaagccaaagacatacacaaagcaaaagttcaaggttctctcattagattccacaaatctattatttgtaaataataataataatttgtaaaattatttctttctttctttttttttttttttttttgagatggagtctcgctctattgcccaggctggagtgcagtggtgcagtctcggctcactgcaacctccgcctcccaggttcaagtgattctcctgcctcagccccccaagaagctgggattacaggcacccaccaccacgcctggctattttttgtatttttagtagagacggggtttcaccatgttggccaggctggtctcaaactcctgacctcaggtgatccacccgcctcggcctcccaaagtcctgagattacaggcgtgagccaccatgcccagcagaagtaaaattattttatcaaattgttatcacagtctctaaggtcatactctccatttctgtacgtatctaattgtggaccagtacaaaacagttcagaaagcagcaccagtccagggaacacattgtgagtagcacagttatcgtggatttactctttcacataatacgtcagtacaaactacagtatgtatcagacttttcaagaattcaagaatagaagggcaagatgatttgacctgagtctattgaaatcatgtgaaacgaatgccagacgagtagggtgtgttgggttgatgcttgtgctcatgcatatatattaaaaatctagctctgagaacgcatggacaccgggaggggaacatcacataccagggtctgtcgggagtagggggcggacaaggggagggagagaattaggacaaatacctaatgcatgcggggcttaaaacctagatgacaggttgataggtgcagcaaaccaccatggcacatgtatacctatgtaacaaacctgcaagttctgcacatgtatttcagaaattaaaatagaaaattaaaaaatgaaaaatctagctctgagggggttaaagtaagaatgttcaaggtcaagatcaaagaagataaagacagtataagaatagtgtctgtttacaatcctttggcttaaagagatttcttctttttctagcgtaaatattcagaaggaaacaacacaagctcctggggttgaaaaacttctacagcacaagaaaaggaatatttttactaaaggttcaaagcaaaacagatctctattatgaaaataaactacaaaaatgaaaagcaattttagagaatatctattggtgctttcaataaaagattcatgaaaaattcttttttaaagtaggaataggtggtcataaagagaactgagaaatataagaatgcagaaataaaaattaaagttaatgactttctgtttcacctgcatgtgcttacaagccatcattcctgcccttacaagaaaaatctggacacactgaaaatcaatgtcttttctctgacccaacagagaactgagttttcagggcaaattgccaccatcatcatctggaaagacaaagaagtccagagagtcacagtcaagctctgcttacctggagcagaagacatgctggaaccataaacttaaatggcagtttggaaaaattgctggaggctgagtgtcgactaatatgacattgaaagacccatgggagctgaagtcatagctgggacccccacactgttgtgggctttacctccaagaaccctgccacgttttcatgatgaaggtccaagaaagacccttcctgtgctggcagcgggaggggaagattaatctaatcatttgaaatatgcccagagacttctccataaaaaaggactactttactaaggggaattactttaccagaggcttatcccacctaacagaagtgcatttcctgtacttcagcctccttagccttcctgtctcacctaagaggggaagttttaaaaaactaagaaatatctgcgaaggtcatagccgaaggtcacatgctcactaaaaggctgagatttcatcataatattatagaacacttttcctccccacaccctactacgacaccaacagggctccagcataatgacagtgaattccagctgaaagagcagaaagatccagattctccctgagggggagtattaaggaatcccaaagtcaagcagggagacaaaaaaaaaaaaaaaacaaaaaaacaaaaaacaaacaaaaaaaaacgcactagaggaatgtgaggtctctggcaccaactgtgattagcagatttagtctttcacgtgatacatatagcaaacatcaaatacagcacaaattctagcctgccaggtccttgcagttataagactgaagttccgttttcttaatgaatactagtcagggactactgtcagcaattagatatcactcccaggtccctttgacctgcagatccttccatgttagcaacagagaacctcccttgcatcaaatctctctcacactttgaatctctctctgactttttcttctaccaccagctagagaagactttactttagaaggactagtgattaagttaggcccacccagaaatttctttaccttagggtcaagactagtaaccttaatacatctagaaattttctcttgcaatgcaacctaatgtaatcatgggagtagcatcaggaagtaatggtcgtgggggccatctcagaattctgcctgccacagagagttcagtaaagtatataaatagaaaatgtatgaagattaatagcttattacccaaaataactagataataaaggtttaagctgtaaaacaaatgtatgatacaccacatgtacatatacacatattctaaaaattgtaactaagagccatagagaaaataattaaatgggaagatatgctatcttcatgaatgaagacagtgaaggccataaagagcttaatccttccaggggtagaccttgatttgttttcccagaacatcatttggggaactaatatggttttggagggggcctaacaaccacagatacctcaaactctagtaatggggtgtggttgcgtgaatgaggctgtgtcagtagtagaactttactcccaagacattgcaattagagggactggcacaggtcccaggcaggccaataagacacttgcttagggaattttaagacagaagctgattgagagaatgcctcttattttcctctttggttggccattgtatgaatttgacttaagaactgctagttttgattggagcccagaataagagaaggcttttgtctaggctgctgtgcgaactgctctgctacttgggacatatgacccaggagctccagtggtgcttaaagtgtcagtgacagagaaggatgcattttgaagtctttggcaagcccctataagtgacacaaaactggacccttagaattttggagctaaccactgccatactctgcagataactgctctctttttcagaaacaacttttgccttgctactgagcctttgtagagactggatgcttaaccatgagccactaactcaccatggaatctgagctccccatcgtgagtttgaggttgttcaactagataagccataaagttgtgtgtgcaaagaagcactccattatcaaatggaagaggtgtatatgtgatcagacttgatcaggccttgaagccacaagtaagttgcatgaagaagtagcccaggccaggtgcggtggctcacgcctgtaatcccagcactttgggaggccgaggcgggtggatcatttgaggtcaggagttcgaaaccagcatggccaatgtggtgaaactccgtctcgactaaaaatgcaaatattagccgggagtgggggtgggtgcctgtaatcccagctacttggaaggctgaggcaggagaatggtgtgaaccccagacgcagagcttgcagtgagccgagatcgtgccactgcactccagcctgggcgacagagcgagactccatctgaaaaaaaaaaaaaaaagaagtagcccaaattctcatggcccctacttctgctatataatttcacttttccaacttgtatcgatggtctggtggggagttccctatgacaaggggaaggaagaaaaacctcagatttggtttactggtgatgctgcatgacatgaagacactacatgaaagcagatagtggcagcatctacagtgttgctcaataacagccttgaaagacagggatgaggggaaaatcatcctcacagtgggcaggattttgagtagtctacctgggtacttgaatggacacttatactggatatggatttaccttctctgtccacaaagcttcttccaaaactaccatccataaacttaccttatctactatcatgatactagactgcttccaaacaaggaacccacatcacggcaaatgaaacatggcaatgggcccgtgctcacagactttactggtcgtaccatgctccccatcatcctgaagcagctggcttgatagaaacagagtggtcttttgaaaatgctgttatggccttttgaaaacaccttgcagggttgggcaatgtcttccaggatgctttgagtcagagtccactatatggtgctgtttctcccatagtcaatattcatagatctgctgggcgcggtggctcacgcctgtaatcccagcactttaggagaacgaggcgggtggatcacaagatcaggagatcgagaccatcctggctaacatggtgaaaccctatctctactaaaaatacaaaaaattagccaggcgtggtggtgggcacctgtagtcccagctacatgggaggctgaggcaggagaatggcatgaacctgggaggcagagcttgcagtgagccgagatcgcgccactgcactccagcctgggcaacaaagcaagactcatctcaaaaaaaaaaaacaaaaaaacatatatatatatatatggtcatacatttaaaaagccagcggtgaaaataggagtagcagcactcactattacctctactaatccattaacaaaatgttgcttcctatccctatgttgtaggctctactagtctagagatcgtagttctaagggagtaatactttcaaaaggggacccaacattaattccactgaaatggaagatgagactgctgcctgtctactctggataccttatgccattgaattaacaggcagaaaatgagattattttctggctagggtgttcagttctatcagggaaaaattgtgtgaccagtagcaacacaattgttactagtaacacaatagagtaacaatcatatatggaatgcaggaaatcttcaagagtgcctcttaatacttccatgtcctagattaaagtcaacaaaaaactgtaacaattcaattcaggcaggactgctaataccccagagctttcaagaatgaagttttgtgtcactccaccaagcaaagaactatgaccagctgaggtgcttgctgagggcaaaaagaatagcaatagatagaatatgggaaaaaggtagtgattgatattaactatgaccatatgacccttgcagaaacaaggactataagagttgtaagtatttcttccttattttaatataaatatgtttttatatattaaccagacattttattttttttcgctttcatggccccttatcatctaacacaagttgtcttaataatagtttactttatatcttagcacttaagttacaagctataaaatgatatatgtgaagcagcctggaaaataataaacgtcacccaaggacaaaaaaagaaacttgggaaaagggttagcatttttttttttcagttgtatgagagatagttatatcacactaggcagaggcatgcctttggcattatcattattcagtgattaagtatactttaaggagatatatatggatgccaagttgtctaggggtggattttaatggctttgtaatgttatcaacttgcctaggctgagctacacttcccagaattcactctcttgtttgtttccagttagggttggccacatgggagattcttgggagatttgaaggctggaagagaaacagtggccattatttcagctcatacatgttgttgtcgatctgctgactcacttcgttggtttgaggcaacagctgggcctgtaactgctctacttttgccctgattgccttttggtttctgtgactcttaggccaggtatgtgtatctagctctgtgacaaaaagtcccacttctgctagatacccttatcaccaaggtcagaggcaacaagaactaacatgtattccagttcttcttcatggggttctagcttgtgcttgttggttccaacctgttcttgatctccccactttacctgtctttctttccctactgcctgccccatggacttcaagctccatcatcagaatcagaaacaataaccatacagagactgcttatccaactctcacaattccataaaggcaattccctgtaacaaatccatattggctgtatgcaattcatatcccctactgattctgcttctttgattggtcttggacggatacaggtgaggagccagtgtggagagaattgagtttaaacatgttaagattacaatgcaagtgaaacaacaatgtaaaaatgtctacaggtaagataatttggaattcagtaggaaagatgaggagagaatatagatttgaaatgctttcatggaggtaaacgctgaagtcactacagtggataagattcttgggaacattggtgaaaaaggaagaaaggaaaaaagacaatatacaattagaacagaggggagtgaaggaagccatagcaaacatcagcttctggatcttgatagaggacatccaaatcccaaggaggaaaggcctttattttttgccagataggacccgagggaatatacacaagggcacatgacccaggactagaagcagactgaaaaatggaacaacatgaggacacatcagttacattttgtggctcaatctttttcctatgaggattgagctccataaccttaaagccctcactgtgggttttaatggagtttgtgaaactaccctttctgcctaacacagcaacagagaaaaaggaggccacaacacttctgaggcaggaatgctttaatgtggtagtgaggaaaccctcatttgtatccccgaggcaatgcatttgaaaaggaaacccccaatttgtatccctgaggctatgtgtttgaaaaggaaaataactggtgtaggactaggactttttaatatacagagactatcctcagagataatgcttccattcaactattatcatattgattcccccaacaagacccattttaggcccaattgggtctgctccgggtcctgcacacatagttctcacccttttatcctttattctcaataagatttttggactgcccacttcaaagatggtgcaactgcccccttgcagaaggctgcattcattgaactgtctctccctactcgcttcttaatccttactgattctgttgctgctttggcacatcctggggccttggtcttttagaatgctgattcatccagcaagcatctgctggaggtaacagccttgtcacatgtttcaagtcaaagaaggatgtgttggaggagagggaaagctttcatttactctcttgtaagcaacccaaaggtcagcatcactgccaggacttagactggaaaatttgtcctggaggctagagaagggtttccagctgcaagaacagctaatgtacatcccctgttggactctgtcctctgtcctccccactctctctatgtgtgtgctcactctaagctgcctctccctgtggttgtgcccatgccctttccccttcttttcctaaagacctctcctggatggtgagagtttctggctcattatgaggtcctcagggaggccaaagcacatgcagaaaccctgctgtttggcaagagctcttaaggctggagccaagtacaaaaaaaatggcaaagtttagaaacaatgaattagtagtccttcctgggttgcatcattctgttagtgataactaatcaaatgcttcatttagtcaaatcctgttggactttttgttccaagtgctttccaaggatcggcctttctctgaccatggtaaatagccaaagaaaagtcaatgcatggaaaggttacaagacttgcacagagacccatgagagttgaacacgtccacactaaatgcagattctgagctatcagcattggggttctatagtaatatttttcatgcagctgtttgaagcttttcctgctttcctgctctggttcttttctctctctgctggagtggattcaatttgtggtcatctggaacacataagttatcaacactttcccccatttgcctcatgttcccttctctcaaaaggagaacatgcagtgatgtgtctcttgagtatatgatctggtatatgaaatccaatgtttggtatatcttattctcaaatggatgccattgcatgacggtcatattatatcgtttcctacaactttcttcctttcaaaaatgttgcctaaaccttctatctccaatatcctagtccaatctgatgtctgcccacatgactcctctgaaataactcttgctgtcatgacctgcgtgttattgtcacctacagaaatattttagtcctcatctttgcacacctctcagaagcattcaacactaataaccacttatcacttctagtagcactaacaacctttagtttccaggacataatattatcctgcctccaacatctctggatgcttctcagtttctagctatccatctgcttctgggcaaccattgaatattggattccatgagaatctctatactctctcccaagatgatcttatccatacttaacagctttaattgtcagctaaacactgagatcccgtaaatctgtatttttaggtccttgtctgtgttcttaactctatgtatcttcttttcattgttcaaatgcatccccaactccaggtctactgaataaattcaggacctctactctgcaacctaattgtcttatgtgtctctatagttggcaccactgttcatccttgacacttttcttccaccatgccccaccccacccaacccatccgtaagtgctgttgattttcctgtttatggtggttgaatccagccctgtctctccatctttattgccacccacttagccagtgctagatcccatcacttgtcaattgggctcccaacaacagccttgtaagtagtcccatgcatccactcctgtccctcctgcaacctcagtttattctctacttgctgtactaggaacaaactgtcactcaccagcttaaaactctttgatgaattactggtgctacagactaaagaacaagattctgactacagccaaaaaggccctgtttgatctggatcctgtctacctatctagcttcaactctgtcctccatgcttcccctcattccatattgtggccacacttctttcagtctgtgtactgttcctttctgcctcagggtttttacacataatattccatttgcttgcatttcctactccttattccaggtaacagctccatattttcagatcttatcttaagtgactattcttcggagaagttctccctgactccctagtagataagtttgcctgcctgtcttatgtgctgcatattttccaagatggctgtaacaataccttccatccattatgctcttcttaacagtgtgacattgacactcctcctatgaaggaaactccatatttcttcctcttaaggtggctatgtgactgtcagaagtgacactgtgtgacttctaaagctaggtcataaaaggtaatgtagctttggcctggtcttttctttgagatgctgactattggaagccagcaaccacactgggatgaagccacatggaggggtcattgagatctcagtcaacagctagcatcaactgctgacatgacagttaggaagccttcaaggttacttcaaccccagtcactgttgaactgcaaatacatgaaacaccctaagtgagaaatgcccagctgagccacgttaaccttagacctatgagatataataagaaataatagttgttgttttgagccaataaattttgagatgattcattatgaagcaacaatagataactgaaacatgtactttatagcatgtatctagttgaacaacttgtttgaaaccatataacatttgtctatttatgtaaagtatttgaataatatatatattcccagatagactttaaatctctttgacacaggaacggtgtctgatttgctcatcactgtatttatagcactagcaaagagcacatggtgggtactcaaaaaacactttttgagtaaattaataaatgaatgaattcctattgttgggacaagtttgtaaaactttcccatatgaaagtttgaattttcccatatgaaagcttgaattaacacttcaatttatctaattgtgtaacctcttaaggcttatttgatgtgacatttctcactaaaaaattaatgactcaaagcacagtgaatgatgattctcattaattcatcaaacatttgttgaccatgtgcaaagtcactttgggaataccaagagttatcacagggtttcttcactccagttgctcacacatggaatgcttcaagaatttaccagagaccattggcatttaagaattccacattttctgttgctatgatctgaatgtttgtgttcccccaaaattcatatgttgaaatcctaacctttaaggcgatggtattaagggatgaagccttttgtaggtaatttagatcatgagagtggagccctcatgaatgaaattagtggccttataaaagaggccctgaaagagaaccctttcttctctcaccatctgagaatgtagcgagaagttgccatctatgaatcagaaaccaagccctcaccagacacagaatctgctggtgccttgatcctggacttccccgcctccagagctgtgaaaaataaatttctgttgtttataaaatatccagtttatggtattttgttatagcagccctaatggactaagacgtgtgtttatttttgtgtgtatgagaaatgactgagtaattttctgtctgttcagcgttcttaaaatgattgagcctctgtgtcttcgtggcagttgtagtgtggtcacatccaggaatcacttgactgtactgaaatgtgattagagaaaaggctgggaatacatacagaaatatctacctatgatgtcttagtagttttgaaggactttgtgaatgccggacatcatctgttggctgacactatgggtggtatggtaaatgagaagttaaagtggactgcagggctcagaaaagctattatggaggtggtgaggcttaaggcagggtttgaagaatgaaagcagagacagcaatgtaagatagagcagaatggtcatgtaggagaatagtgagagaggcagctggaaagaaaaattggagctaagttacctggatctttgatgatcaggctaaaatctacttgattctgaagcctagaacctataggtgagtgattctccaggagaatgcaatatggcttcctgggttgtcaaaaacacatgcttctggagagcctaatttgcactgtcctacctggggtgcccttctccttctttcctgcttttctaagatcccttctgtattgaaatagtaagcaacacgcccttgtgactgatgagcatatgttgtttctctgggtgggttatatcaaaaagaaaataaaacaaaaagattgaaattatgtataatatgatctgtgggtatccacggagatttttttaaaacataaaagcgatatgagtaaaacagtctctggagaagatgaccatcgcagtggttgcaatgagcaagaaggaaaatcttgaggcaggaagttgatgcctcagacaatgttggttgtcaacccaacattcattgcctgctttttcactgctagcagagacccagttttgatcagttcccctccttgctctacaagaattaggggagcttgactccattcccagctctaggggaaaagcggtacttggtgtaagccaatcatgacagtcctgttcctcctaccaagaatcaaattaggagtgtgcatgtggcacagtaggacactgagatgtaaggggggcctgtgaaaggtatcttcacttcttgttgcatatcgggttctctgaaaaaacagactctgagaaggcaatgagcatgcgggaatttcatgagggagtgcatttgagattgatgcctgtgggaggaaagagaagacagcaggagtgggtgagagagactttcagctgtgatgtagtttcagtgaatgcctcagccagcccaacaaagaactctaaggatggtcctgcggagtcgttctgagctgaggtgaggaagctggacctttatgtactggtgacaaacagttattggatattggctgctcccaggaagggaaagtgaatttcagcaaggcaagtatcttcagtaaagggcatttccaaaaaggactgacagctgcaggctctctgctaaaaacacctccagcagctgagagaataggtccttcaatcctaaagaggaatataggtagcacatttcagcatccactatactcctaaaataatcatacagacaagagaaagtccctcttgttccactgacattatgcatgaatgtatgcctggaatacaatagccatttcacaaccagactgagactggagtcaacacaggaagatgaggagaatgaagagaacgacaagagaaatagaaccagagcctgtatccatgttgcctggagcctacctggggttctggactccttcatataggtggtaaaaatgttgttactgtttgcatcagttgagttaggcttttctcttacttgaaccccaagcatcctagccaaggatggatacttcaggcaacagacgataaggcttgaaaaacatacaaagaatgggaaagaaggcacaggtacaagaaatattgcaaagaaagcatcagtaaaacctaaggcctggcactatgaggtacaatggtgacttcatttttataatagtcacaaacttccttgtttttggaatggccaaatgaattaaatgatggaatcaatattctggcaaatattttaagtggttgatgtggtctgtttgtgttttgtgatagcccagaacaaatcgtacctcaatttctttctggggaactacctttccctattgtgaaaaatctagtggaatgggaaatccagatgtctccccgtccaactatgaaagcccaagagtttcaggaagtagcatccacctgattcttctttatttccctgatatagtgtaaggcaggcaccttttcttggccatcttgaccttgaattagaagaagagacagaataagtgacaaaatggttgtatttttaaaaatttcaatagcagcaccctgactgttcctacaatgcctatttcccagtgctccacccctgcccactcaaagctgcccctcttttgcctgcttccaaaccttttcttctgccttcctgtcaacattgcatactcctgaaatcctgctcacgtttcaccaatatccagtctctctttaataatacaacccctgagctttagctaggcacatgaattcccagctcagggtatttcaccctcccttgcaatttgatatagtcctaagactaagttctgtcacggaatgtaagtggaagtaatgtatgctaacttccaagttgttccttgataatggaaggttcacatgctatcctgagcctctccctttaatcttggctaggagatgaaaactgggcagccatcttgaaccatgaaatggaagcatgttgaggattgcagagtggcttcactagtcttggattgcacatttctggactgtgatctgagaaagaaacatgtaccctgaatcagccaatctacagtgggtctctgtcacagcatcttggcatctaccctgaataatataacttctaataagttcttaatttttgaacaaacttatctgacatgcctaatcaattagtgttaataatatgaaaatattaacaaaattaaaactttagggggttttgtagttcaaatattggcagacatgaaatatttaaatgattccgtagccaagagaagctgtgcagacactggaatatttatagtgtaagacagtaagaatcgtggtatttgtgtttccataacactgaggaaccatttccaccttggatccaatctagaaattatttttttcctgccaaagcctaacttggataaaatcctctccttcacaaatgtgaagcagaagccataggaggagaaaactgagtttccatagaacagaggacagagacacagcacagagaataagattttatttccagagttgtacaataaaagcaatgggatttttgtagaatgttggaggagatgaactagcctagtaatatagttgctacatctcaaaactttaaagtaatttttgagcagttactcatgtagacagttttctatacattttcagaaagaccctacagcgtagacatttactgaccaccaaatacctatgtgcttctctacgttttctagccttcttgcaattaggtagaaccatatggctggttatggctgtgaaaagtgtgatatattgttcctaagcttaagcatttaagagccaacatatgtagttaaaacctcccacaaagaaaaccccaggcccagttgacttcactagtgaattctacctaacatttaagggagaaatcataccaattctcataaaaccttagagaaaattgaagaggagggaatatgttcctatgtagtctatgaggccagaattactctgatagcaaaaccagacaaagactacaaaaaaagaaaactacagcccaattttcctcttgaacatagatgtaaaaattctttaaattttagtaaattgaatcaagcaatatataacacaaaaagtataatatatcacaaccaagtagagtttatcctaggaatacaaagtagttttaacattcaaaattcaatcaatgtaatttatcacattaacagatcaaaaaagaaaaataatattatcatcttgatagatgcagagaaagcatttgacaaaaattcaacatctattcgtggtaaaagctttccacaaactaagactggaaggaaacttcctcaaaccattaaagaacgtttcaaaataaccgcagttaatatcatacttaatggtgaaggtagaatacttttcccctaaggatgtgtgctcttgccacttctattcaatattttactggaagttctagtcaatgaaatcaggccagaagagaaaataaaatatattcagattaggaagaaaaaaatgaaactgtctattcaaagatggcatgattgtctatataggaaatccaggttgggtgcagtggctcatgcctataatcccagcagttttggaggccaaggcaggaggatcacttgaggccaggagtctgagaccagcctgggcaacatggcgagaccctgtctattaaaaaaatccaaatccaatagaatttacaaaaagttgttagaactaataagtaagttatatataccatttactatacaagcaatcagaattgaaatttttaaagtaatgctatttgcaatagcattaaaaatatgagagatctgtagataaatctggcaaaagctgtgcatgacctgtatactacaaacattaaaatattgagaaaaattaaatttcatggatctgaagactcaatatttttaagatgtcaagtctccctgaactgatctttacattcaactcagtccaaatcaaaatctcagtagacttttgtcatggaaattgacagacaaattctaaaatgaatattgaaatgcaaagaactagagcagcaaaaaccactttgaaaaagaaaaataaatttggagaaataacactccctgacttcaagatttattaaaaagctatgttaatgaagataatgtggtgttggcataaaggtagacaaacagatcaatgaaacagaagagaaagtccagaaatagacccatgcatataagatcaattaaattctgacaaaggtgccaaggcaatacagtggcaaaaagatagtattatcaacaaatgataatgtaaccatcacacatctatatgccaataaaaagagcactttgatccacgtctagaagaaaacacaagaaatctttgtgatcttggactaggcaaagctttcctagatatgacaccaaaagcacaatctataaaagaggaaaataatgtgaaatgaacttcatcaaaatgaaaaaggtatgcttctcaaatgatgatgttaacaaactaaaagacgagccacaggtgaagagaaaatatttgtaaattatatgttcagaatatatgaagaactccaaaatcaatcataagaaaataaataagcacccaaaatttggaatagacacttcacaaaagtagatatacggatgacaaataagcacaaaaagatgctcaacatcattagggaaattccagttaaaaccataatgtgatattactacatacctatgagaatggttgaaatttaaaaggctggttatatataccaaatgttggggaaaatatgaagaaattaaattctcattccctgctggtaggaatatcaaatggtacaaagacttggaaaatagttaggcagtttatttaaaagttaaccatacacctatcatatgagccaaatcagaattatgctgaatgaatgaaggcaaaacaaagggtacctactgttattattcgaattctataaattgtagacaaattaatgtatagtgagaaaacattagtgatagcctgggggaggggatggagaagggcggaaagagaagttacaagggggtataaacaaactttgggggtgatggatatgttcattatattgaatgtggtaatggtatatatacatgttaaaatttgtcaaactgtacactttaaatatatgcaggttattgtatttcaattatacttcagtaaaaccattttgtcaaaagtgctgtaaggtgaagatcagattaagggtgtagccctcaataaaatctcttacttgtacaaaattactcaggaaaaaaaatgtaattaagatgatggccttctctgccctcttctagattctttcattattaaatcaatagagagagaaagatgtgggatttacaaaacagcaaaaagtgtgccagatctgttaattatgtcctcaaaagaactatgggtgtggctgttacatggcattgactacaatcatattttaagaagtctaataaggctttattaagtttatttttaaagtgtcaaattcagtggttttagtatagtcacaaagttgtacaaccaatatcgctaattccagagcagtttcatcagccccaaaagacacatcatacctaattagcactcacttttcattcctccctcctgctaacccctggaaactagtctactttctgtctctatggatttgcctatttcggatatttcatgtaaattgtattatataaaacatggtctttcgcatttgtcttctgtcatttagcataatgtttttaagggtcatccgtgttgtagcatgtgtcactgcttcattcctttttatggataaataatattccattacataggtgtgccatttttattaatcagtttacccattgttcagtctaacaagtttttaagagtcttgtggctgggcgcggtggctcaggcctgtaatcccatcattttggaagacagaggagggtggatcatttgaggtcaggagttcgagcccagcctagctaacatggtgaaaccctgtctctactaaaaatacaaaaattagcctagaagtagtggcacgagcctgtaatcctacctactcgggaggctgagacaggagaatcgcttgagcctgggaggtggaggttgcggtgagcccagatcaggccactgcactccagtctgggcaagagagtgagaccctgtctcaaaaaaaaaaaaaaaaaagtctcgtactgctagagaagccacaagtctgggcaataacaaatggaataaaataagacgactattcaagccttaaaatcctccaaggaccttgagtatatacaacctttatttaatcaatcaaatttttttttaatgaaataaaccatctttgggtccccagtcttctaagggcagcagacaacactagatagactcaaggagggcatatatgttcttcaataactactttagttatggcaagaagcggaatagaaaaaggagagctgctagagggcaggccagggaccaccaagaacaatggacaagagagtttcttccagagagaaaatcagggcctgattcagaatgttcttcactctcaggataggggcctccactcacacagagcagttttggaactgctacatccagtaactgctgtgtgtctctttctttccctttccaaatgagaatgtttatttccaccattatatgttaggtgtgtgttggaaggggaggccagacaattcgttgttttcattaggcttttggaccaagaagaaccaggactggtccagaggtgaaggctatcgtgcattgcccagagatgcagaattataagctatattaatagattacatgggactttgggtggcctcccttggggaatggtggagggtattctatacatgggaatgtatttagatcaggaggaaatttccttttggctaaaggcaactttccagaagaggaagcagctgtgagccactggccaacattaacagcagctgggagatgtgtgcacctgcctggtgaaagtcatcaaggtgggggcaccaatagcatctactacagggtgaatggaagcaaggggatatttggtaaacagaagtgtggaccgtggcagaggcatctagtgcacattgaatatccatgtgtttctccacatttccaagccctctttacaaataaatggggtcatgtggccaaagtgcttgaagaagtaaaatttgtcacttttgaggcaaagcatttaagagtctcctagttcttctcttttcctgcctcagcaatcatgaagctcaaatgttaagatatcagtgtcggcgtggtggctcacgcctgtaatcccagcactttgggagaccgaagcgcgtggatcacctgaggtcaggagttcaagaccagcttggctaatatggccaaccctggtctctactaaaaatataaaaattagcaaggtacagtggagcatgcctgtaatcccagctactcaggaggctgaggcaggagaatcgcttgaacctggggagtagaggttgcagtgtcgcctgggcgacaaagcaagactccatctcaaaaaacaaacaaacaaacaaaaacaaagatatcagcgtctccatcagcctgtgtcgctatgtggaacagagctacccccaaagctcaccttgttggctcacattgaacttatatcctgagctcagaataaacctttgttgtgttaagccgcttgtttgcatgtttatttgttatattatgaattggtttatccattcaagtttgattaggaaagcagagatactgtaagtgatatggaattttgaatttatgataaggattactttaagatgtcaagtctccctgaactgatctttacattcaactcagtccaaatcaaaatctcagtaggcttttgtcatggaaattaacagacaaattctaaaatgaatattgaaatgcaaagaactagagcagcaaaaaccactttgaaaaagaaaataaatgtggagaaataacgctccctgacttcaagatttattaaaaagctatgttaatgaagataatgtggtgttggcataaaggtagacaaacagatcaatgaaacagaagagaaagtccagaaatagacccacgcatataagatcaattaatttctgacaaaggagttgtggaagctggtgaggaaccatatagaaagctgttgtccattgagtacacaaagaaggaaacaatagatacagggacctccttgagggtgaagggtgggaggagagtgagggttgaaaaactacgtatcaggtactattctcactacctgggtaacaaaattatctgtacaccaaacccccaacatgcaatttacccacgtaaaaaacctgcagtgtaccccctgaacctaaaatagaaattgaaaataaatacattaataactaataaataaaatcatagccaaaaaaaaagagttgtggcctctgcatacaatgatgagtgtgaagtcactgtaggtagcagggccagaaatcagaaagaaaagttgaatataaagtgggagaaagcaaggccaaactggagcccataaggacaaactggaaaccatccattactgactgtctccagtttcaatgatgtgcgtgacctgcagaagttgacatcttttgccacggagctgcatatgcatctggctcagaacttaaagaaactgaaggaggtcaggaaggaggcaaagaatctgtgggcccagctcttgtcccatatcaacaaagtgacccagcatatctgcagcaatatgtacagcctgcaggattgcctggctccttacactgagctgcagagaataatgggtactacttcacctttaccttctaaattctcttgtggcccaccacaaaagagaaccacacagggaaagaaattctgagaaacacagttccaagttagctaagttgacctacaaagccactacacgtagcctaacgtaatacagactcagaaaagtgatggcagggttatacccagaacttgagtaacacaacaaagtaagaaaaaatcaaagtgaagacaattctctcagccacacttggctaaagatattcatcaattcatagagaaaaaattaaaaaataaatgtaggaaatcaaataattatagttaatgctgcacacaatttaaagtatagtgattaagagcacagattttgtaaagtcaaaaatccacttacaagctgtatgatcttacacagttacttttttttctctgtgactcatttctaaatctataaaatggggatagtaaaacttttctcatagggttgttgtgaagattaaaagagttaataaaaataaagcccatgtaactgtgtttggtgcataagtgtttattaaatgttaatattttcactattatgtataaccatgctttaactttatataagatacacacttataatgctcggtaaatttctaggttgtctttatgaagttccaggtgaaaagtttcctccatgtgttatggcagatagctacttggaatggggacccctacctgagagttgtaggcaagatgctgttgtccagaatggggaaaaccaagtctgtagtctctcttgcagaatacttcccttgcaaaaagatgtctgatataatctatagctcagtaacatgaattattatcacttatatattaagttggtgcaaaagtaactgcggttttgccgttaaaagtaattgcaaagccgcaattacttttgcactgaccttatgtgcatatatgtttacgtgtgtcattgacatgggacttctgacctagatcaatgatatattcacattctgtgaataattagagagaaagcagagaccatctacttaaaaaaatagacttctaaaatttttcctgtgtcttctgttaaggcatcctcttaggtaaataaagccaaggtattcaagcaagtacaattgtggtttatcagactcaattctagatctggtgataattctcactagaacatctgtatgtatttgtgtgtatgtgtctgtgcatgagaggctattatcaaatcagagtttgtattagtagatgttcacagccaatttggttgattgtattttgttaacaggtatgactgggcttttccaatttctcttatcaaaaagagaaaaggtattcagtgacaagtaaaaaaaatcatagagatggttaggtgtagtggctcacacctgtaatcccagaactttgggaggcagaggcaggaggatcacttgaggctaggagttcaagatcagcctgggcaacatggcaagactgccgactctacaaaaaaaaaaaaaaaaaattagcagtagctgtgactatgggaatgtgccaccatgctcagtttactcagcaggaggattgcctgagcccgggaatttgaagctgcagtgatctacgactgcttctttgcactctagcctgggcaacacagcaaaacccgtctctttaaaaaatcatagagttgcattcattgagacttatgtctgcgttcttttcaaggtctctagggtagtgagtgggctctccctgatggtcatggttgattccgtgccatcagccttcttgtgtctaggggacccatatggaaaaaagttacccacattcctctctctctgaccatgctgttcaacttaaaccagatcaatgtagatttttttaaactgaaggatgtgtggcaaataattctgtttaataagagaatcctgatttttagctaggcatattgcttctaagaataaaggactacattttctggcttaccttgttgtagaaatgtgatcaagttctggccaatgggattaagtggaggtggtgtatgcaacctttgggaaggctgtttaaaggagctaactcagtggagggctttttgcttttcttccctgttctttcctaggtggaatacagatataatggctgagctccagcattcaccctgggatgtgggatgacctaaaggacagaagttacatggtaagaatggctgggcaaaaagttgggatgatcatagattcctgatgactttgtgaagttgtcataccaattgtcgtctgtatacctatgagcttgttttatgcaagagaataaactattgtgtttttagccactgtattcaagtctctgttacaactagctgaatacaattattaatacaatcaggaagtcctggaaggtttttagaaacatttttctttgccagaatggtatctcctgtggatcctccttcagttccaaatctagtttcccacctcaggttggtgacaactgcccaaattcaaatgaccattgaattctcccccatatgattgcctcattcctttctacaggaggaacttcaccctggggttccttaaagcattaagcagtgtctttgatttcagccaataggcctggacagagactagctggtggctccagcacaatcctggttttataaatgatgataatgtgcatcatccattctagtttacacatcctatcagtgacaactgcagagttgatggcccatttaactatgacaccaactgtgtcatgtcagtttaggtcctctggaaagcagatgccaatatggagttagatgtacaggagatacattaagagtaacacatgtaaatgataaagaggaaggtgaaatcccatagattttccagatataagtggtggacttagtttgttatagatggggaaaaccccagctttgcttgttccccaaggctgaggtcctggttcgaggtgaatggtgattacagccagatatttaacgggaagagtctggaagtcagagaaccatagaagtgctgagataagctctctatacttccctggtggatggccaaactaaacacatgggagagacccaaaagatcctggggaaaagtgaaagccaagggaaacatgaaaactggctgcaactttgaatacattttttaaccacacacagttcaatcagcagagggtagaagccttataagctcaaactgtttcaacacaacctcagccaaattgattggcaataactaagctattcagagatgggggcaatctttagaaagttgggctgaaatgttaaaataagaattaaaaatgtgagcagagacatcagtggctgcatactaggagtgaggtgagtgaagcagattctgcagtttaagttcagaaaaggtattaaacaccaaacaagcaaaataaacaaaaaggcttcagaaaaataaaacaatcgagaattattacaatatattctataaaatgttatctgaagtgttcaattttctttttttctctcttttttttaaatactgctccttgcagagcagggttaccctataggcagtgtgccgagagtagcctgaagtgttcaattctcaactaaaaattgatagacatataaagaaactggaaagtgtaacctaaactcagagggaaaagtagtcaatagacactgactctgattgaactcaaatgttggatttagcagagactgccttcaaagcaggtattataaatttgtcaaagaaattaaagaaaactatgtttgataaattaaaaggaaatatgttaatagtgagttaacaaatagagaatcttaatagtgaaataaaaaaactaattctagagttaaaaaagcacaataactgaaatgaaattttttattttttattttactttaatttctgggatacatgtgcagaatgtgcagatttgttacacaggtatacgtgtgccatggtggtttgctgcatctatcaacccattatctaggttttaagccctgcatgaattaggtatttgtcttaatgctctccttcccccaccccccgacaggcccctgtgcgttttgttcccctccctgtgtccatgtgttctcattgttcaactcccacttatgagtgagaacatgcggcatttggttttctgttcctgtgttagtctgctgaggatgatggcttctggcttcatccatgtccccgcaaaggacaggatctcattcctttttatggctgaatagtattccatggtgtatatgtaccacattttctttatccagtctatcattgatgggcatttgggttggttccatgtctttgctcttgtaaatagtgctgtaataaacatacatgtgcatgtgtctttatagtagaatgatttatattcctttgggtatatacccagtaatgggattgctggtatttctggttctagatccttgaggaatcaccactctgtcttccacaatgtaaattaagctagtttacattcccaccaacagtgtaaaagcattcctatttctccacagcctcgccagcatctattgtttcttgactttttagtaatcaccattctgactggcatgagatcgtgtctcattgtggttttgatttgcatttctctaatgatcagtgatgttgagctttttttcacatgtttgttggctgaataaatgtcttcttttgagaaatgtctgttcatatcctttgcccactttttgatgggtttgtttttcttgtaaatttgtttaagttcctcatagattctggatattagacctttatcaaatgggtagattgcaaaaattttctcccattctgtaggttgcctgttcattctgatgatagtttctttgctgtgtagaagctctttagcttaattagatcccatttgtcaattttagcttttgttgcaattgcttttggcattttcatcatgaaatctctgcccacacctatgtcctgaatgatattgcctaggctttcttctagggtttttatggtttggggttttacatttaagtccttaatccatcttgagttaatttttgtataagacataaggaaggggtccagtttcagttttctgcatatggctagccaattttcccagtaccatttattaaatagggaatcctttccccattgcatcttttttgttgggtttgttgaagatcagatgattgtagatgtgtggtgttatttctgaggtctctgttctgttccattggcctatatgtctgttttggttactgcagccttgtagtatagtttgaagtcaggtagtatgatgcctccagttttgttatttttacttaggattgtcttggctatgtgggctcttttttggttccatatgaaatttaaagtggtttttttctaattctgtgaagaatgtcaatggtagtttgatgggaatagcattgaatctataaattgctttgggcagtatggccatttacacaatattgattcttcctatctacgaggatggaaagtttttccatttgtttgtgtcgtctcttatttccttgagcagtggtttgtagttctccttgaagaggtccttcacgtcacttgttagctgtaatactaggtattttattatctttgtagcagttgtgaatagttcattcattcgtgatttggctctctgcttgtctgctgttggtgtataggaatgcttgtgatttttgcacattgattttgtatcctgagacttggctgaagttgcttatcagcttaaggattttttgggctgagacgatgggattttctaaatatagaatcatgttgtctgcaaacagagacaatttgacttcctctattcctatttgaatatcttttatttctttccctgcctcattgtcctggccagaacttccaatactatgttgaatacgagtggtgagagagggcattcttgtaatgaaaattttaacaaagctgtttaacatgtcagtttggtcaatttatttgagccccattttatttttttggcagctgtaaagagtaaattacttaatcaatgacacactgttgatctctgaaacagagactattcataaaaggcagagaaaataattattttcaaatgttattatgtttctgcttcctttctaaaaagttttttgtggttaacaactaagtgttgaaacatgagccaggtgcggtggctcacccctgtaatcccagcactttgggaggccgaggccagtggatcacctgaggtcaggagtttgagaccagcttggccaacatggtgaaaccccatctctactaaaaatacaaaaaaaattgctgggtgtggtggcagttgcctgtaatcccagctactcaggaggctgaggcagaagaatcacttgaacctgggaggtggaggttgcagtgagccgagatcaagatggtgccattgcactctagtctgggcaaaaagagtgaaactctgtctcaaaaaaaagaaaaagaaacataaaaactatttgccaactccattgagccttacacaaatacaagaacaatgtttccttcagttgtttttggaaggtcatatttttactctggaattattattgataacataattcatattattttcagctacttggtcatggcaggcagttgctttaagcaaagtgtactatgcttgctttaaaaaaccaagtttcttcagctttttcagctgtgctcaaatgcaaatagttcagagggaggtccatgtttctctgtgttgtttggatttccatttctttcaaccttggccatttcaatcccttcaaggtctctttttaatgtgtcctatggtttacttgatgtctaatttctcccaacccctcacatttctcttttatggttatttcccttggtatcggataccaaccctgaggaaagtgctctgctaggtctcaagaatgcaaaatttacatcatgggggaattttagagaataagtaacatataggcatgtaaattatacacccactgtctagttgatatcaattttatcagtttacacatgtaccttcttactcctttccgcattgcttcacccacacactgtctgagccctgtgtcttatatttcaatccttgatgaaagtaaactttgctggttttataaatatgaaatcctgtcactaagaagtcataatcttatagtcctgacactgaccccatgctgaagactggggtgtagtcttttggagcatttctcttctgactcctgaaatcactgacttggatatattcgtggccagagtaatccctttgctaatgattgtgaaaaatgactaaaatatcacccaaatataatgctctattcaggttctcaggaaggaggcataaaatcttttgcaagtcatctaatcttggaaacaaaacttgctttcaaataaattcaaacatagtctgttacagccttagggaacaaacagaatgcattgattattccatttatttgatgtttaggcccatctaagaaaatggtgataaattcatgccttagtaaatcgtagacaatttccattattctgtttcctcctctacctatgccttcccacacatacccactgcaaatgttgctgccaccactatcctaacagccaaagaatcattttttgtagcactaaagtggagcatgaagaatgggataaagggtattccatgtgtgtgccgttttcttggagtagctctgtgatacccatcccactgcccacatccaatttactgtatgtgataagacttggagtacacatgttacggttagggataatatttgtacatactgtaataatgaatgtgcactgcgtggatttttttggagtccacactattatcagtgtgggaggtggagagaaaacacatgtgtttggatcttcactgtatactctggagaaggggaagagctgatgaacaaagtatggagaacaaaatcattcactcgggtacaagagaaacaatcggggtgatgttagcaagtccttgtgatcagaagcaagaatggagagggaggcttctaaagcccaaaagattttaaaaagagagttatagctatggcaccagtctttgaatatacaggaagaccaaatcctgggctattagaggtcaaatggaggaaacttactgggaatgagaagggaaagggtcaaagagtcttgccaagttgtgtcatcatatgaagctagagtgtacttatattagcgaaagggaatttgggactcagttaagctcttttacatatttttctagtattcttaggactacacatgtagtgaatttttataatatgttgtctcagcatcattttgaatatattggactttctcataccagaagcagggcttagtcacccttgacacagtttcctgttctccatctcctccctgttccttaatgtggtcgatccagatatctaccttatacagtcacctgctggtgaccacctccctatgggacagctagatacaacctacttgactggccccactgaccccccacactctacatgggccgcacggatctgccacagcgaccccttctcagtcacagcgtgcctccatggaactcctgcctgctggctttcaacccaccgatgagaactccccacgggaaagcggcctgggaatgcctggaccccgataaaggcctaggcccacaggtccctcactctctatcttgctccccacctgctggctaagcatggatggcccagagggttccttccttcttgctggccctgagaggaatctgtaaagaagatgctgcctctggtatttcacacgttctgtggagctgcctctctgtgtctcaccccacccacacacccggacctaacttctttcccggttggcgttctcctagagagtggccctcttggcaggaatagactcgacacaggtcagacaagagccacaagggcgcctgcgactataaacaactttcctgtgagagggacacctggtcatgggttgagcacttaggaatgaggctgtctgccaggataaagaagtgtcccgaggccccgtccccgcttccggggcgctcgcgctcctcctctccgccccctcgctgtgggctcgcgcagtgagggtcatggtgacctggggggcatggggccggcgagctccgggaggttcgcatcctcggggactgggagcccagttatcggacccaggcgaggcccccagcttatgacccgcccccatcgccgtgatcctcggggccggggacccccgactccacgcgaccgtgaccacatccaggtcccccaaaaacacacacacgtcccttctgacctgatgattccactcccatcatctcagagactgtccagcgcccccctcccccggcttgggagcttgtcatgccagtgcagcagacaatccatgtacacacgcacgtctggcctggggacacctgaggtcacctgaccacatagaacccctccccatctcttctgacccgaggattctcccgctcgctctccctgtgacagtgtctggcgaggggtaggggggttgtcccttttccccaacctggcaatgaccttggcattgggctcagcagacccgccttccacatgcaccaggccccctcaaacccctgtgaccagtttcactgccaccatcttggtgagtgtgtgtctgacctctccagaaatgcacatcgacccccagtcagcccggcgactttgtcacctgtgctcaagtgatgtctccccttcccttcacacccacctgacctggggacatctgaggccaatgtgactctatctaggcctgccccctagcccccagcacatgtacacctgctttctgatcagtcccaccatctcggtacctacctccctgacatcttgtcatcctagatcagcacctctcccgctccacacacgcctggcctggcaacgctgtgaccacatgtagtctcctggctttttccctgaagagcctggtctctaaatcctctgggctggaaggaatcagattttcaaaccctgtgaacaccacccctgacccacgatcctttttgtgtctttcttgacccagtaaaatgctctcatgtaaaaaaataaaataaaataaaataaaaaataaaataaaataaaaagtggtgtcccatgaaaagcagtttgtaagcttccccgggagttctgtcagggcagggctaaaatttatagccactccccagagagattcctgaagactgaattagaggaaaatcaaaacacatttatgctttggagaaaacttgactgttttatgctgtttgaattgtcttctaaaaatgagttttaaattataaaaagtattaaaataaatatgtcatattccttcactcagttaattgtgaaagcacatggattgactcttcactggcacatatagtaggtatattccattgtggtagtttccttgtttttctgggatcacaactagcctacactttccagtttcccttgtagtaagttgggcacatgtcatcgaacgccagtggaatgtgagcagagtgatacatgccactttcaggcctggaaaatgccaaggctcaaggaaaatgctaaagccatcagatgatagatgctaaggtccctgaatgtgtggagcaaagccaactactcacccttagtgtactatcatgtgaacaagaaataaacatttatcatgtttaataactcataattggagtgtctttgttatagcagttaaactcccaggctaatacagccagtgactttcagagaatataacctggaaatttctgctaattattactagaagcttatttgtgacaaataacattctgaaggtgtatagtaatttgtaagttcagatcagttattctcaattcttagtgttgtgtcagaattacctaggaagctattttaaaagatacatatcccaaaagactagccttgacctagcgaatcagaagtagataagacataggcagttatatttgaaaaacttccttgtgttttacatatacccttggctaggaaccactactctaagataacccaaattttatctttagatgaagccagattatctgacctcattgttttggggccatataatttattttcctggattgggttgttttaaagtatagtttgattgtacttaaaaaattaacatgtaataacactgatctttttgtgtaaacagttctacagttttataaattttacacatttaaagtttcatgctttatcacaaaaattaggacacaaaccattccatcatttcaaaacactacctcataatacccatttgaattcacacccttaaccccttgaaaccactgatctgttatccatcattaacagttttgtgttttcgagactctcatagaaatgaaatcatacagtaggtaaactgttgagactggtttctttcactcagcatagtgcttttgagatttattcaagttgctgcagatatcaacaatttatttcttttaaggctaagtagcattccattatacagacctaatacagtttgctttccaattactattgaaagatatttgtgttgtttccaggtgttggagattgtgaatagagcttctataaaacatttgaatacaagtttttgtgtgaacctaagttttcctttcttgagggcagggctttttaacttcagcattattaacactttggaatggaaaattcgttttcagggttatcctgtgcattgtaggatatagtatcgctggcctctactcactacatgccagtagcattctcctcgccacctccccactccaagttgtgacaaccaaatatgtctccagacattgtcaaacgtccgctggggtggggagagggaaaatctccctggttgaggaatactgccttaaaggaattgaaacatctaatattactttagtgtgagactgctagtgacaaatatcaccttttgtctttaaaatttttatgatacatatttgtacatatttatgagatacgtgtggtattttattacatgcctagaacgtgtaatgatcaagtcagatttaggggatctatcaccttaagtatttatcatttctatgtgttggaaacatttcaagtcctcccttctaacgatactgaaatatacaatacattgttgttaattatatagtcaccctactctactattgaatattagaacttgttccttctatctatatgtttgtacatcttatgtctatatgtttgtacccattaaccaacctctcttcatcctcgttccatgcacctgtcccagcttctggtaacaatcactcgactttctatctctatgaaatcaacacttttagttcccacacgagtgagaatatgtgaaatttgtctttctgtgcctagcttatttcacttaacataatgacctccagttctatccatgttgctgcaaataacaggatctcatcctttttggtggataaataatattacattgtgtatatatacaccacattttatctattcatctgttaataaacatttaggttgatttcatatctttgctattgtaaatagtgctgcaataaacatgggggtgcaggtatccctttgaaatatcaccttttgttttaaaatgtctctgctacctacatttctgaaataaattttctctggatccgaaattctaatttggcagttttttttttttgacagggtctcactctgttgcccaggctggagtacagtggcatgatcttggctcactgcagccttgacctcccaggcccaagcgatcctctcacttcagcctcccaagtagctgggactacaaaagcacaccaccacacctggctagtttttgtattttttttgtagagatgggtttttgccatgttgcccaggctggtctcgaactcctgggctcaagtgatcctcctgctttggcctcccaaagtgttaggattacaggcatgagccaccacacatggcctgttttctttcattacattaaaaaataattacattaccttttggctttcacagtttctgttgagaagtcagttatgtcttcatagtgttcctttaaatatgccattcttcctgacagctttcaatatttttatgtttggtggtgctgtggtcacctcacagaggtgaaatggattttccccccaacacaagatttacttatgatgatgtcacatacgcatccagaaggtatgaaaatgtttattacatacataatgagtcttactggggaaagcaggcatgcacgcatcctaagctggtcgaaaaatgtcttgagaaaatagagaagactggcttgggatttttatggtagttgaggggtggggctgggataaaggttcccacatgcaggctgaggcttgagtgttttgaacttccagctactaccaaaggagggagcacctgagctttcttgttagcttgcccagatgtagggcagagggaaacggaggagtgggcttaaaagttgtcaacgaacatcaccaatggagtcacactctagtacaggtgttaagtaattttattatgaattagtgttgttttatatttttcttgcttggggtttttagtgcctcttgagtctttgggctgtggcctttcattctgaaaagttctcagaaatttttcttcaactattgcttttgttctattctctcttctctttttgggattctaattacacatatatttgaccttgtcatactactacaaatatctcaacaactatcttttgtattttgcatcattttgtctctcacatcatattttcttctggactctttcagtttactttctttccatcaatgtatcagtaaatccacacactgatgtcttaattttactgtttgtatttagttctagaatttaaaattcattatttttttcacagcttccattttctactaaaatcctcactcttttgtattaattccttgaaaatattaaacttcagaaacaaccaatacctcttggtgaaaaacagccccatgtgccaagcacatctatttgggcttcatttctctcccaaattttgacctcataattcttattttatttatttttttagacagagtctcgctctgttgctcaggttggagtgcagtggctcgatctcggttcactgcaacctccgcctctcaggttcaggcgattctcttgcctcagcttcccaattagctgggattgcaggcgcatgccaccacacttggctaatttttttgtatttttaatagagacggggtttcaccatgttggccagactggtctcgaactcctgacctcaggtgatctgaacctcataattctttactgtcctgatagcattcagatactttcaaatttgttttaatatatatactttagtccaaattttctatctgttcccagtggtaggatggtctgagtcacttactgggaattactagaaacctagacacttgcttttaaatgcatgattacattttacaagacaactgtccctgtttgtaaaatgtcaatgccatgaaaaaaatatgggaagagctcttttagattgaaagagacttaaaagactaacaaacaaatgcagggcatggaccttgattgatttccagtttaaatgaaccagcttgtaaaagacattttgagaaaagcaagggaaatgtgaatatgagattgggtagcagttgacattagaaaattattgctaaatttgttaggcaagatacgagcactgtggttacacaggacaatgcacaaaatgtcatttgttgaaatgcatcctgatatatttagggttggaatgtcaggatgtctagctaaaacatgaagcaaacatagcaaagtatgagtgaaagatctatgtgatgggttcatgggtatttattatattatactttcttgtatatttgaaatatttcaaaataaaaaagtttttaaaaaccacaacagattaattttaaataaacaagtttcatatttagagtaaattttccagctttcatttctaaagtcttatctagtaattactgaggaaaccaacttatacgtctatcttttgcttaaagttttctccaattggtttaaacttttatattaattttctaattaattgctatatgcagtaaattaaataattgcaataattaaggagttaatataaatctgatggcaagttgtaacatatgttacctaaaaatataaaatcaaatgttcatatgcacagagttttaatgatttttaagtaattataggctaaaaacaatacaatagaaaactttgctgttgtaataacctttgtgtccacaggggaaattctgtaaaaactttaaaagtagtgtaatactattttgacaggttctgaacaaattacttggacagactgcttttaaacctcaaaagattttctagaatattaaaaaggtgttcaccttgggacagattttttttttttttttttttgagacggagtctcgctctgtcagccaggctggagtgcagtggcgcgatctcggctcactgcaagctctgcctcccaggttcacaccattctcctgcctcagcctcctgagtagctgggactacaggtgcctgccaccacactcagctaattttttgtatttttagtagagatggggtttcaccatgttagccaggatgggacagatttttaccactgaaccagataagatctttcttaagtaaaaataaaaagtgtcttattgtcacttacacattccttaaaattagatacagttctctagcccactgctacttaagacatctcatctattataatatacatagtatacataccagatgaaaatagaagcaagtggaactatttgggaatgcagcttgccgtgccagagaagttttcatgttgtagttttagtgaatatttttagggttaggataacatttcctgatgttttcggtgattagtattgtacagtaacactatgccaaagtagttctctgtcacaattgttagagggactgcttatcaagtctgtctgctgtctctgaactttattgtagcttcttccaacagaaacattctacttcactgtttaatacagttgcactacctcatgatcctgactccccacactcaaaagaaggcttagtatgcatctgtatgcaacaggaaacttcaattaccttagtagaatgatcacttttctagtcaattctttaactctcatttcatgcttaaaatctcagatcaaattaggaaagattacaactaagataaatccagggcctatttcaacatgttttccttgtaaactagtttctcttgccaaaataatgtactttgtttaaaatagaggtcacaacttggccccttgagagccaaatttagcctgcagttatggcttggccctttctaagtttacacacacacacacacacgcgcgcgcgcgtgcatgcacacgtgtgtatgtgaatgagttatccatataaaaacccagatttccagcttctttttaaaacagctgaggggctggcaatcagagcacaatactgggaaacagagcaattgccagctagaacagactggcagcagctccaatgtgcttacctgcccagccactgaaaacaatttagttatgtgactcctggtttacatgcattgtttgttcaattcaataaagtatctccctcattcctgagatgaagattttccaaccttttgatttgcctcctgtttttacttgctagtttcttattcttacaaggtaaaaaagtaaagcacatgttaaagttctgtctaaaaagatactctaagcctttttttttttttttttttttgaaacagtctgtcactcaggctggagcgcagtggtgtgactttggctcactacaatctctgcctcccaggttcaagcaattctcctgtctcagcttcctgagtagctgggattacaggcgagcaccaccatgcctagctaatttttgtacttttcatagagatggagttttgccatgttggccagactggtctcaaactgctgggctcaagtaattcacccgccttggcctcccaaagtgctgggattacaggcgtgagccaccaagcctggccggtactctaagctttttaaacaactactatcagatgagaaatctttaaatcacaggccccggcaaaaggaaatattaagtatggaaatactttcgattttggttgcctcacagaatcaaagtgggcagaaaatctcggaattcaagttgaggaacgtaatacagaaatcagtatggctctgtcccataataattattctgcatcttatctctaatcctgttgccacttgggtctcctgtgggtagaggtctatgacaataacttctttcttgttgccaaccttgatgattataatactagttgaccaaatgttccccttttggatgcttctgacggtgttctgttggaagagacagggtcttccctgctcatggaaagactttgttttccctttatggatttataatagcatatgggtaacagaattgtactgcaatgaagcatatggcaagtattttaaaaaatggagtttaaccttaaagcatgtgcgtacaaatttctgagaaacaaatccttgtctgaacactacaagtgtagatgtgatcatttgtttagtcatcatttaacatttaatacttgctcattgtgtctaggatactgaaaaagatagccctgaaaattcctgctttgatgtaactggagatacattaaatgaaagttttaacatcacaaagagcctccactggagacatatcattaaaaatctaggattcagcaagagtctctagagaaataatttaggagactagacactataaacaactgaagggttttcttggtatgatgtgtagctgtcaaactgaagcaccgatacgggctgaattttgttcccccaaaaagatatgttgaagtcctaactcccagtgactcagaatgtaatcttatttggaaacagggtctttagagaggtaatcaagttaaaaggaatacttagggtgggttctaacccattacgactggtgtccttataaaaagaggaaatgtggacacaattacacacagaaagatggtatgaagacaaaggactccagtgatacatttacaagccatggaatgcctgagactaccagaagttaggagagagacctgggacagatccttcccaggtcccttcagagggagcatggctctgccaacaccatgacttcagacttctggcctccagaactgcgaggcaacacatatctgctgttttaagccacccagtttgtagtactttgttaaggcagccctgggaaactgatattacataaaagcacctttcaaaactacattttcttattatataaggagggtctttttaaatgccaaattttctttatcttaaatgttttgacatggatttgcatgctcttttataagacctaaaaatcttaccactgctgatatttaaaaaattaatacctatttaacatttgatccataatataagtgaacaatgtcaatgactccctaatgctcaagtcaatggattctatttttcaggtcccattaaggtcagtaagaaagccttacgtagtatcattatagagaggagaaaggaatgaataggaaacataacaaatatgagtagtttgaggattagaagaaatcatttaactttttgtaaagctataaagttatcagtaagggcggccaggaatggtggctcacgcctgtaatcccagcactttgggaggcccaggcagacagatggcttgagcccaggagttcaagaccattctgggcaacatggcgaaaccccatctctacaaaaaaatacaaaaattagctgctcatggtagtgtgtgcctgtaatcccagctacttcagaggctgaggtgggaggatcacttgagcctgggaggtagaggttgcagtgagccgagatcatgccactacactctagcctgagtgacagagcaagaccctgtctcaaataaataaataagttatcagtaaatgcaactccatttatttttgaaactagtaaaattgatcattatattcaattctattgattatctcttctgtgtttttaaagagttctcagatattagtttgtttttcaagtttagtgtccattaatctcctttccattcacttagaaaataggttttaaaactgccataatatctcctattcatcatcagagtcacaccccattttcttcattttactcacatgtaactgtaactgtgttttcttagtttctggcataacatctggcatataggaggtacttggtaagtatttcttcaatgtaaatgccagatagggaaccaaatttagaaaagaaatataatacaagtattcaaagcccaagggcagatggctggtatgtttttatagaagtatttacccttattattaaaattatctcttggtgttgatgattttcaacaaaccaccttattaaaaagtataaattgttttgagacctctaacaaagcagggatacttcatctgcttggtaaggtttgtctcatgcacctcctccaagtgttttgacttaatcctttctttggaaataagctatttgcctaaaagctatttgatttccttggtctctaagctgtccctttctccttttgaatgaccggcccaatgatcagtacagtggggaggttctgacggtctttatgacccttgccttctggtattcatgcccttgtgctatctcctcactttactttgagtgtgggtgggacctgtgacttgcttctagccagcagaatttggcaaagatggatgtcactttcatgatcatgtaacctaaaattatgacctctgtcttgttagcagactctattgactcttccttgctggctatgatgaaggaagccaccatacagacaggttctttcccataatacaagtgctattagtttttactgctgcacaataaattaccataaatttagcagacaaatactacatgtatttattatctcacagtttttatggatcagtagtctgagtactgctcaactgggtcctctgctcagggtctcgcaaagttgtaatcaaggtgccagccagggctgtggtccaatctgaggatcaggttcctcttccaggctcactgggtgctagcagaattaaatttcttgcagttgtaggactgaggacttccgatcctaaaggctgtccaccactccctggcacatggccctctccctaaatatggcagctggcttcttcaagcccaacaggagagcatctctgctgttttgaatctctctgacttcttccatgtcaaacttttagagcctcttagaaagggctaatctgattaggtcatggccacttaggactatctcttatttgcttaacttcaagtcaactaacaaggaattttaattacatctgcaaaatcttttatcttttccacataatgtaacgaagcaaagacgtgacatgccgtcatattcactggtccaacccacactcatgaggaagggattattgagagcatgtggcaccagcaggtgagaaacttggggttcatcttagaattctgcctaccacgactggcatatcttactaccacttgtgagctttacttccacttgactctgatagtttatattttagtatttttgcaatactgtactatcattgcaacagccactttttattatatttacctttaataaaattaaaattctactaaatgtaacatttacacagaagactattttttaagatttcaaaatcacatctattctgaactaacatccttacaacccctgtgcacgaaacgcaaagatgaagtttctttttctttgtttaaatggggcaatggtcactgtgactgaagaataaagtgttctatttacaagctagaatggggaaaatgaagatactttgctttgttgaataagtagtacctgagagcataagcaaacaatgtttctatcagagtagacttgatagggtttggatgtttgttccctctaaatctcatcttgaaatgtaatccccagtgttggaggtggggcctggtgggaggtatttaggtcatgggagcagattcctcatgaatgcctgggtgctttcctctcccataatgactgagttctcactcagagttcatgtgacatctggttggttaaaagaatgtggcacttccaccctctccctcttgcttcctctttcgccttccatgtgacgtgcctgctcccgctttgctttctgccatgagtaaaagctaactgaagcctcaccagaagctgagcagatgccactaagctccctgtagagcctacagaaccatgagccaattaaacctcttttctttataaattacccagcctcaggtaattccttatagcaacataaaaatggactgacacaagacttagcagctttatccttcctattctttgtggcagagcactgtgtgactgaaccaaatgtggttaccactgtcaatgccaggaaaagctgaaatgagcaagcctagctatgttcacctctcctatggtggtgatcggtggaatggtcaaacactccagatgataccaaataatctgcaatgttttcatggcaagtcatttccctaaggaaaggagtaggggctgggcacggtggctcacgcctgtaatcccagcactttgggaggcccaggcaagcagatcccgaggtcaggagtttgacaccagcctggccaatatggtgaaaccttgtttctactaaaaatacaaaaattagccgagtgtggtggtgtgtgcctgtaatcccagctactcgggaggctgaggcagaagaattgcttgaacccggaaggcagaggttgcagtgagccgagattatgccactgcactccagcctgggcaacagagagagcttccatctccaaaaaaagaaaggagtgctgggaagcaaagaaacttctgcactcagttttccacagatgtaccatttatacagttgcactgaaattttctttactcaggggtaaatgcattttgcatacttctatattttaaaattatttttgcccccattttgtcaattgctaatgccaagtacctcctaattttattaatacttatcaatgttaacagtggaactgaccagatatagtttattaaaatatgttcattataaacaattttacctcagttttgtaaaaattgtaaatacatcaaaaactgttacagtgtcgtaagattgcaaatattgccttataaaattataaagaagtaaaattgtttagtaaaaactaggaaatatcttatttcaattttccacatataaaaatatattttttattgcaatactgaacagttaaggccacaacactttagggagaatttgagatacacatattttgaaatgacttgttaaaaatattagcataaataaatatcaaaactggtcacacttatagaagctgaataaaacatattaagtcttatatcttttaaagactactatcagaaactttacttcataagttataacatttttcaagtatacattacaatacacttggtgactgtgaaaacataaatatatatttatagtattgtacaggattttgatcttctctctgtatttgttggtgggatattctgatgattctgactcatgtggttctggtcggcatctttattatcactttttaaaatgatctggtctcctatggattttatctctgggagcggctcattgttattcttgacaatcttttgatttattgaggggactcttttgaacagaaaaatctaggaaaaaaaccacacacacaaatattcatttccataagtgaaacattcacttaacagtatttaggggatatcattttcaacacgtaagaacatgattttgtcatctctttatggggcaccacatgtactatggtgcattcttagcatctgttagagtttttcctttcaccaaaaggcagtcaggattccaccctaaaacaagacctctcagggtctaacattcaacaccatcaacaccttggtgatatctttttcttcaaagaacaaatttaatgtttcactttgttaagttgtaagagaaaaaatatataaaaacctatttaaagttacctattgtaacttttaaatgtatccaggaggggtcattttcaggacatgtctgtgattctcagtgtatcgcagctacagtgaatttctattgtaatattctgaagaaggacgatgtacctccccattcctgtagatgagaacttctggcaaaaaagttaatgctgcttggccaggcgcggtagcccatgcctgtaatcccagcactttgggaggccgaggcgggcagatcacaaggtcaggagatcgagactgttctggctaacacagtgaaaccctgtctctactacaaatacaaaaaaaaaaaaaaattagccgggcgtggtggcaggcacctgtagtcccagctacttgggaggctgaggcaggagaatggcgtgaacccgggaggcggagcttgcagtgagccaagatcgcgccactgcactccagcttgggcgacagagcgagactctgtccccaaaaaaaaaaaaaaaaaagtcagtgctgccaaatgatggctgtgtgagccctgtgtgtgggtctgagtaggcagtcaaatatacagagctgctgctcaggggaggctggggctgcagatatgtagaatatagataatagctgagagatgaaagtagccccgataacccagagattccaggcaggtagaaaacagaatataagaaaagaggcaaaaagagcagagtgagaggcaggcagaagaggagctagaactgaggaccaaggtttgtaggtgcaaaattgggaaaactaggcagctcagaagtcaggagagaaaaatacatcaagaagggagtggccaacagggcatgtatgcagaagagatgaaggtgataaaagtttcatttgatttaggccctttgagaatgtagccaggaagaaaataggattattgaagagtggtaacacaaataatggttttgacaagatgccaaaacaaaaagcaggaaacaaaaaccaggtgaaaatttggctcttccagaaataaaaatggtgctaataataatagcttacttctagctttaaagagtggagaaactagggtaaaaagtgataatccaaaaagtaagaatctagaaaaaggatctatggattaaaatggaagaactcctgttcctgctatggtgaagaaatacacaacttcaaaaagactgccactataaaataccaagaaatgctgattaagtataaaaaatataattttataatgtgcaggtaatctccccaaaaactaagggaaatccttgtagaccaaaaaagaaagaaggaacaggaagcctcagaggtcattaagaactgaaatagcatctgctgactcataacttagacttttaactttgaaacaatttgatctcacaaaatgaggggaactggaactgagacccctacataatgtgaggaccttctaagtactatgcccttaatataagtctacctacaaacattgtggtctacccttaaatgagaaatgaacttaaagtggtccttcagtcactccagagctaataaaggctaatgcaaactctctatagatagacttactctaacagaggccttaaaggatttccacaaaaaaagtaccagtgaaacatgaactcacaatacaaatttcaaaacacatatggaaactaatcaccattagcaagtcagccaaagcaacacacatttagactgctaaggatgacactggaattactaaatacagaatgtaaactaagtgtgcttaaattaaaagactagaataaaaaaagtaagcataaaacaagatactgattttaaaagaccagattgatttgaaaaagaacaaaaatacaacttcacttaaaatgtgaaagatgttatcactgaaattaaaactttaaataggtaggttaaatagccaagtagtctcagctgaagagaaactatgaaattgatgaaggccctgaaattacccagaatatcacttacacatagaaaacaagaaggtgatattaaaagacatgtacccataaaataaaaagttttatatcagaatttgaaagaggggagagaaaatattcaaatatataatggatgagaattttaaaaaaattgacaaatgacatgaattctcagattcaagagtcataataaattccaagtaagttaaaattaaaaattccatacctgctgggcatggtggctcacgcctgtaatcccagcactttgggaggccaagacaggcggatcacctgaggtcaggagtttgagaccagcctgaccaacatggagaaaccccgtctctactaaaagtacaaaatcagccaggcatggtggcacatgcctgtaatctcagctacttgggaggctgaggcaggagaatcgcttgaacctgggaggcaggattgtggtgagccaagatcgcgccattgcactccagcctgggcaacaagagcgaaactccatctcaaaaaaaaaaaaaaatccatacttaagcatctcatagtgaactgaaacacaccaaagacaatctaaaaagcagccatagagaaatggcaggttatatacaaagttatcagcaattatactaaagcaaaattatagacagcaataatgggagcagatactaagagaaaataactgtcaacgagccacactatcattcaagaactatggtaaaataaagacattttcaagtgaacagaaactaaaagttttaactgtcaacagacatctgtgataggaacttccaaaatatttcttcaggaagaataagaattccagaggggacatctgagtaaaaaagtagtataaaaaatactaaaaacatacgatttgtgatgttaaaaaattttaaatactgggtaccataacttctaaaataagaaagaagaggtgataggcaagaaaattcttctaaggtcctggcattatttgggaaaaagataggaacattgatgagctttagattttaggtatgcatgttaaaaatgtcaaagacaaaatccagctgtataggccatttacaagagacacatctaaaacataagctaaagtaaaaggatgaaaagaagatcatcattcaaatgctaaccaaaggaaaggtagtatattaaaaatatgcgacatcacctgaaattcttcaggttttggggccatgaaaactcatattaagagagttaaattatgtggattgccatatgaaaagtaaaacaaacaattgaattcaaaaggatcaaaaaagacaattcatttcacttaccttctttgtttttttcatgtctttgcttggtgttgtttcactgttttctaggatttctaatgaactgctatctgcatcatcaagcatgtatcctacaattggatcattcagaaatactagttttaactaataggaaaaagacaagacctgatgctctcagtgaaactctatgaaccctgagttgtggggtaatacgaaaagagctcacccctggagtagtggacaacatctacactgcatatttcctgaaaagttgagttaaagtgaaaagcccagaatgacctcaccaaagttgtaaatgtttagatgaccagtatccaaatatagctacaaaggtaatagtcaatgttagagaagacttctgtaaaatacaaattactttaaaaattaacctagttataattacattctttgtactcaaatggacatgctattttttggtgtttcaaattaatccacatgttctatatctgaataattatcttcaaagtatacttgtgaagcatatgcattgttttaattttatattatcaactacttttaagcttatatttaatttctttgtagtgctttaggctatatgttaagaatacttataggtgatacattttttaacacttgcctaaaatattctaaaacttactactcttatggcagaagttaaaaggaacaggattaaggaaactattcattcttcagcttaagtttagatcagatatccagtattacagatagttatttttttatgagaacacaatcatactgccgtgtgatggtgtggaaacaatgtgggagtcatactacagaaacacagatgatttgtgtctagattatgtagatctcaagggcaatcacagtctcctctattccacagcacctgctctctgacactgataggtaggcttgggaaaggacttctcttcagtatctacggtaagacactcaggtctgagccctcgggggtaaataactgggtggccattgtggctttaggccagcccagtagtcccaacttggttgggcaatggagtctagcagtgtgcactagagatataaattggaatttggggcaaaagcttgatttaataatactgatttaatagagagaaaaaaggtagtaaaaaggctacttaaattccttaacaccagccgggtgtggtggctcatgcctgtaatcccagcactttgggaggccgaggcgggaggatcacctgaggtcaggagtttgagactcgcctggacaatatggcaaaaccacatctctactaaaaatataaaaattagccaggtgtagtggcacacgcctgtaatcccagctactcgggaggctgaggcaggagaatcacttgaacctgggaggtggagattgcaatgagctgagatcgtgccattgcactccatcctgggcaacaagagcgaaactctgtctcaaaaaaaaataaaaaattccttaacattgacacataagtagccatgaataatgcaatatttgtatgtgaagaagctgtggtggttatatataagaacagataagtctgtatcacatatttcatagcttgttatgaggatcatgtgacagtaaaaattatagcatatatgtaaacttatatgtaagcttataattacccaattatggcatacatacacatatatatgtgtgtatgtatgtatgtatatatgtatgttatcaaatgtgctcataccttttgggttttcattgtactcacaaatggcccgttcctctaggttggctttttctttctataaacaataacaaagcaatataacaaaaaatatttttgtgctgttctagaaaacttaagtctgaatctttaagcaggttctagagtctgcctctagctaatgacataaacatgtgacaattacttcactttgctgagctcttgtaaagtgaggggccttagatgctgactgattgcaaatgtcctcctagcttaaaattgtgtgattaaaaaaactgtatgactcaagaattctcctcaaagaagattcatgaacgctaattggcatacaacttgtctcaacattttacaatgtcaaattggtatttaatgatttctatgttaaataatcttaaggaccaccctaacctgaattcataaatgttccctataaacagaatcattttctccttctgaaataaaacagtaactgctagaatattttttttcttagtgagagaaaggagtcttggataaagaaggaaccaagcaaaagaatgacctttaccacaataccaatttgtaaattaaaaatgtatgcacacaaaacatgtttcacaagtacacattcaaataaaatgacaaatatgtttcagtggttgtctatgttagggaaaaaggggaaggggaatggagctaaaagagaatacatttacatgagaagagccttgcaacagaccaatgatgagagtgtttcatactagaaggtatgactcagtgttctgcatgagaggttcaaaaaatgaaaataaagatgaatcagtacaacgtcattcactttgggttgcggaattccatacttctgaagttaatccagagtagtgttagcaaacaaatgatttcaaacctacaaactatctcctagcaaggtcactctcagtcaaaactgccaatggaagagattatgttttgggcttctctagctccactttcagggtgatttttgcttccttagtgatatcttctcctattccttctatacataattttgtctagactgcacctttgaagaactgatcacaacttcaaatactgctgtgaccaactttcaatcattcacacatgtaaacatacacaggtgtgtgtacacatacacaccccatttctgccaccagtgccagggctcctaactttgcactttcagcatttcaaggactgagtgctgaacttcttggttaatttcccaacggtgtactatcctggcccataccattctacttccactcatgcgggaggcagaatgctaccaagcagcattctagaaagtgtgctagagacaaagtttgcttagttcacaaataagccaaagcctttctcttatggcacatgaattcatgtattcatgtattcatgggagtatttctgatcccaaaggcaactggaatctgtcctctgcagaaactagagaacccatatgttttctcccaggatctcaggatttaagcatctatcatcataccttttcaatagtttcagctgagctatcatcattggttctttctgctccttctgttttactgtgataacctgtaggaacactttcatcatctcccacagttttcttcttgctttccacattttcagcattaatttcctcatccacatcttctagttttagttcctcagttttagaaaattcatgatcctgtgacaaaattgaccatcagagaagagtaagattttcttgttaaaaaacgagggatttgatattgctgtcataaataatttgtgtcatctaaaaaaaccaggaaaatattaattcaaatattgaagccgaagaaaaaaatactgtacagtccatgctgaatatcaagttactgtattaacaaggattttacgcatgccactctatttcaatgactaggatttccaaaattcttactagcacccatggcaaggttacaatggaaaaaaaaaataaatactctttcttggttgtctcacaatgctttcaaccttgagaaaagtttaaaaagcgttctgtctactgtagcattataacataatcatatctatatattatattcattttccaaaatatagggatttagaatcacttcagaagtacgattcactgacagtcatgaggaagataagtataattatttacattccaggaaaaaagataaaggaacatagacagtttaaatggtttgctcatggttattaaaagcagaaggaaaaccaaacagaggcagaacttgttctgtctggctactggccagctaatccaaacgataaaagaggctgtctatggatttgatagactgatagtaaatcatggaatgcttattaagtataggcagaaaatattagtttcagcctttattctacactgagatttcttttttttttttaactttctaattttgggtgaaatactctgattgtcattaagatattaggtttctcattagattcccccccatacttttcatttacacacttcactaaagttataactttatagtttattataattaagtttattataactgcttctaaaatatgtgaagcagttatcagtgccatttactccttcaaataacatttgtacaaagttcaccttggcaatatttgcttcagaccatatccccttcaacactgtaattagcttttgatggtcagctttctagtagctgtctggctaaggataaagcctgactgatactcaacagaatctttagtaggtggttggaaaataatgcctctaaaatttaactcacctttcttctggtaaaaatataaaatgcgagagtccaggctaggaagaggatgtttatacagtacaccttaatagtaaacattagtgtcatcctcaggccaattgcaaaggcgtggcctaatagcattcccactgaggacaggaagccctaagtaaataaagctttgagattttaaaaagagtttcagaagctactcaggaagaattagatttaggttaatccaaggtcatgaggcaatgtatgcaagagaggaatgtgggagaaaggaacatggtaccagggcagacagctatttcaaatgatgattgattagactgggtagggttaacatgaggtagttatcatttacttttaagctttgtttttgtctgcatgattccaaccgcctgttttttgcttttgtttgagacagggtctcactctgtcacccaggctggagtgcagtggcacaatcttggctcactgcaacctccacctcccgggttgaagcgattctcctgcctcagcctcccgagtagctgggattacaggcacccaccaccacacccagctgatttttgtacttttagtaaagacggggtttcgccatgttggccaggctggcctcaaactcctgacttcaggtgatcctcccgccttggcctcccaaagtgctaggattacaagcgtgagccaccacgcccagcctgatttccccttttgagtgacttatattgtgtatcatgcctagccaggtatacattatgggtagctaaaattatcagaaacaacttcactttgaaagggaatgggaagattactagatttaagacttatgactgatagttgtctgcataaatatacataaatgaaaggttaactaaaaagaacagtgctcctgagacaaggaatttcagactatgcccctcttttcacagagggagggatcagtgagctgtgttcccagcataatcctcaattacttgggaagcttggctaacctagcacctgggtcaactccaactgggcttgttaactgaggtattcatgtaaccacaggataatgtcatgctattataaaaagacacgtgggagttttaccttattttagaaataagtaaaacactcataacaaactacaattttactcattaactttaaacaatctataacaatgaagaacttttggaactatatcattttctaaatttgagaaagctattagaaaatgacattttcactagaaatcacatcatagcactcacagactaagcacatttaaaattattctaaacacatctggacgactacttgaagtcacagaaagcacttaccttttaaactgaaacaatttgggagtgactggcagaatactgtcattttataaaaagaaagagtaaagtttaagtacattcttggcactagaaccatctaagaagatgtaaacaggtagtctgaaatggtcagtatatgtctgtgtcttgcgttaggatcacagtaaagaagtgaatgggcctgacctctcacaaaaggaccctttgtttcattggtcaggcatggcacagtcaggtgcagactctggtctggcccaaggcaacacttttcatatttcttaaggaacagaacaagagagcaaaggttcctactgaggtttctgtttacttaagaacacaattacatcgcatgctttaaggagaatgctgggatgggggctggggggtggggctgagagtgggaaatgactgaaaggggttaaagtgaagcttctgagggagctggtactgtgtttttccttgatttggatgctgatcagtttgtgatgggtgtattcactttgtgaaaaatatattgagggacacatgtatgagataggcacttttgtccgtgggtattatagttttttaaaagtaataaaacaaaccagagctataaagtataaaattttgtgctataattcagaatttctgacatgcttcaatgtcatgtagggtagaaaatgtttcccagataggttaatatagcataaaactttgtatttaagttatatcaggtagaaaaatcaaaatttcaagtatatattttttttttggacaggaaaagttaacctgtaagttcatgttttaactacactgaaaatcatggaaacagcagtatggggtgggaagggcattaaatacaaagccctaagcactgctttccaagccttaatctaatcactcatggcctgagcatggcacccagtgaatgtattttatagtctacctgtaaaatggaaaaataacattagcaatacctacctcagagggtttgtgtaaagattaaaaagattatttacagagaaaaataacatgagcatatactatatatttgtatataagtataaataattttgtagaggcccctccataaaaagtaagatagaattcttagtgtgcattgaggactgtcgaaaaacagtaagtttggacttttttttcccataatgtcccagatcttatcactggaaaatagttcatttaaaacgtccacttatttttgtgtcctctatacatccttttattgtgagccaggagcctagcatcaaggccagtgagggaaggagccatgggaactggggagaggggtgccagcctcagctcagcttcaggtcagtgttgccacagtgtgatgctcccagacccaggctttccaaaagtccaagaaacattattattatttgagacagggcctcactctgtcactcaagctggagtgcagtggcacaatcacagcttactacagccttgaccttcagggctcaagcgatcttcccacttcagcctcctgagtagctgggactacagggcgcacaccaccatgcctaactaatcttttaatttttttgtagagacaggtttttatcatcttgcccaggctggtcttgaactcctggcctcaagcaatcctccagcctcagcctcccaaagttctgcgattacaggtgtgagtcaccatgcctggctgagaaactttttaaatgtaaaatctcctgacatttcaatgttggcaaccaatatgatttaaataaaaaaaaactgcaccaaacaaaataagtctgcaggccagactgcacccatgggctgccagttgtgatctccaaattcttggctgatcatactactttataatctcttaaactcttccttctttctaggcaccactcccttatgtcattcctaatcctgtattctcaccactgaatacattccagtttgataggcaggcctacagaaataaatgttcagagtatagaatatcttgctggcgagcatttttattctcattttcagatttattctttactatctctactctttttccttagaagattttcttgttgtccataaacaaatgcatgatccacgactataccttatgtgctaattatttttatttattttgataacaaggttaggacacagagggaaatgttcagtgacagaaaacacacctaaattttcggctaaccacatgagtgtgatcagcgtttcaacacactttaaatatttaggggcatttattgactaatgtatggtgtgtaatagtttcactccaccttatacttaagcatgatcattattgcaatctactttattcccacagatctatttctataagccaatttatattttgctattatgttacatttaaacaaaagtcaggttcacatgactaaactcacgcacatcagtcagtgacctggagattcatgagtgtagctttgcacctaccttggtgtgatcacagagtataattagagtgatacaggttaccatttgctgagtgcctataacatgtttcatgtgttaggtaatttaatcgtcaaaagtcccttcctttatcaaatgagggaaataagactcagaaaggtcaaataacaaccaccaccaccaccaccaccacaacttttctaggtgtccacacagctcatcagtggagggctgggattttaactcagttctactggactttggagcccatgtttgtttccaaacctgctcatttaatttgaggataataatggctgttctcacagatgttttttttctccgcctcactaatgtttaaagcattgcagatttttcttttggttcataagctcacatcaataacactctattcttatgtatatattaattatgaacaaaatttatcatcttttccccagaaaaccaaagtctctggagtacacatctcccttcctaaattgagaaatatgcttaaaaaattaaatattttaaaaattaaatatctatatctgatatttaattttcacagttctgattctattcctctgcagagcagatttcccggagctcattctttcctggcaatgtgggttctgcccctggccctctactaggctgcctcctagaggctctctctgcagctactaccactccttcctctctgaaaccccttctttggcttgggtggtatctctctttcctagtaagtatgctcccacacctccttctcagacttcactttctcaacctctcccttacctactgacatttctctgaattctgtcttcaactctcctccattcacattaggaacacttcctttcagtcaaatccagttttaactacatctatgagctggcgatactcagcagtctccgtgagctccagatccatacaggtatctgcctcctgaacatctcctacaatctaaaatcaacagtaaaaaactgtctcccaaacatgcttctgctcccttattctcgatcttgctgaatagtactctttctactcagttctccaggtcagaaacaagaaaagcttggcctttccttcttccatggtcacattttatttttgctatgtaagtgtatagcaagtttctctatagtgaaataatagaagacatttcagttgcactcaccttgactgctgctgttcagcagcagcagcagcagcagcagcagcagtttctgtggtaggtaatcctttgcagcttaccttaaagtctttttcagccagagtcctcattaggaaatgtaactcaatggattctatatatactactcacacttccctcaataatgatcagtaataaactactataaaagcctgaacaaccagcagatgggaacaataaagaaggaaccagttattttaatctatataaccaagtgttaattcatgagggacaaagtggtctcattcttaagcttccttttttttctcctaagatatataaaatttacaaacatgtaaatcacttctgtcgatgaaagcctggatagacctgggtcttttgtaccccaacccacccctaacccacaatacactcctctccataaactttttgagggtactagacctgccacatgtgattaaataaatgttcgcccaacagtgggcacagaaagttagtgtgtgcttagtagtttaggataactgtttactttagtataactactagttagtttgaatgtggggtcgctttggtgacgagacttaagattttttattgaggaaaaaggaattgcagaaaatctgggtgtgacagagctctagctggtaatgaacaactgctgttcctatagaatcccttaggtcactcattctcattctataattttccagatgaagaaattgaggactgcaaagctaagagactagcccaagttcagacagctcaaaagtacaaaaccagaagaagggctttggtctcaaagtgactagggaggccagtgttctccactagaaaacaatgcttgcatgaactaccacttctaaagagcacaaaatgtttttggccagggaaatgtgaagaaatgctatttaaacgtggacatatagaccaggtttaatactgagatgggtgtattttagaacgttgtttctgtattactggctgattatctcttcagtagaagatgaatgctcatagctattacattaataacttgagtttaagagtttctcatttccctggaggtttttttctttatgaattctgtgtcatccatcttaattattttaaatctactttttaaataatcatgttcggcacatatatttttatcatagtattaattcttttctactatcccttaatgaatgtggtcgaattcggtaaagcaatgcaatgccaaatcagtacatttggttagttaggggaagctgccagagatccttgcagctaaggcaaaacttacaattgctcctaggaaatcctttacttcatacgattctagactttttcctcatattctttctcactcagagaatcaactgtgcaaaagaactcaactacacaaaactcacaggaagtttctcatcaaaatcctccttaataaaactaagtataagaaatctctcatgcccaggatataaaagggactatgaaaggaaattagttgaaaaaggagccacaaataaactatcagataaattagctgcattatgtacacggaaaattttaagggacaattgaaattactctagtggaaatctagcctctctaaaattcagtatctaatactagacagtttatcttttcataaagaatttctgactatatacatttaattttttattttacttgaaacattctgacaaggaacagacaaactgaaattacagaacagtcagtgaatacattgagggcatataacacataccagaaatgaaggctctgataaagtacagttaaagcttggaaatgataggagtttagaaataaaaaattacagaagacaagagacgttaaagctgtcataacttttcaagagtaaagaaaacaactgtatagaaaactaaattaattttaaagtgtaatttttctccctaaaacgtttcttacatgaataacaataatgatagagtgaatctgtgagaatgaaaagaatttaagagttagaagggactgcagttatcacatcatctcatccactccattttagagatgaagaaactgaggcccaatgagtacctttgcctggacaaaaaatacttcaagttttacatatttccagattatacatttaaattaatcaccatttcattagatatactaccatctgcccagatagtaactaaaagagatcacgtttttgggatctaagctctgaacacagctgtcactttgtagatttttgcaaaaagaacacataaaaggtgaaagacaatactttctttaaaatgtgaatgcctcaattgagttttagaataccatccattattagaaaattattctatacagtaggtaaactgtaatcactaacttaaaaaaagtgctaacatatttataagaaattagaagtttttatagcccttaagcatctgtgccatttaaaaatggaatgatttgtatacacaaacaaaacactcttgtagtatattcctgtttcctaaagctgcctttaatgaatatataatgttaataatctgatatgaccttttaatattttctagttatgtttttataatttgggggggaaatacacgaaaattttagtttgagagaggccaaaatttaccagtgcctcctattgtctttggctccttaacacagctgcatcagttgcttttttttttactacacataaaataattgacataaaatcaatttaataacacgtaatgagtgcccgttatatgcaaggcatttaaattgtctgactggccataatcgggtcacatttaaggtttgttacttcaattccaagtaatgtggtaatacattattccagaactttttggaacctgatggcccgttttttaaaagtcgttttgactggactggcattttggacctctgctctttcccatttccctgtgtgttagtaactgactttttttgatatgttttatgtttgccatatttcacagatccttttattttgctcacttttttgtactcctctccatcctgcctttcattctcttcttcgcctgtctcctgatacttcccctcttcttcctcctcctcttctctgttcctcctgttttcttctccttccccctccttttccctttcttctccttcctcctctccttcctcttcctctccttccccctctccttcctccccttccacctccccttccacttccccttcctcttcttcctccccttctccctccccttcttcctctccctctccttcttcctccccttcttcttccccttcctcctcttccccctccccttctccttcctcctcttccccctccccttctccttcctccccttccccttctccttcctcttccccctccccttctccttcctcctcttccccctcccattctccttcctcctcttccccctccccttctccatcctccccttccccttctccttcctcctcttccccctccccttctccttcctctccttcctcctcccctttcccttctccttcctcctcttctccctccccttctccttcctcttctccctccccttctccttcctcctcttctccctccccttctccttcctcttctccctccccttctccttcctcctcttccccctccccttctccttcctccccttcttcctccccttctccttcttccccttcttcctcccctttcccttctccttcctcctcttccccctccccttcctcctcttccccctccccttcctcctcttccccctcaccctcctcctcttcctcttccctctctcctttcccctcctctacttcccctccctctacttcccctccctcctctttttcctcccctctcccctctgtttcctcctcttccccctctccttggtctccttcttcctctcctttctcctccttccccgctctttcctcctttttcctctctccttcctccttttcacgttctccctccacttcttccccttctccttcctctttcccttctccctccttctcttcttcctcttctctgtctccctcctcttcttctccttctccatgctcctcctcccctccctcctccatctcttggtttctttccttctgatggccctgctccctctccttttgctcctgctcttccccatccctcttcttccattcttccttctctgctagttccttctctccctctcctggcctctccatttctcctctacccttgtctttctcccccttctccctctcctcatcttgccagtgttctgctcctgaactaccttcctcacaggttccatcccctctaccttcaggcccatcctctgcttctcccactgattttgccttgccttcactcacctctgctttgtctgtaaggtcatctgataggatctctgttttctcctttcttcctccatgcaccttcacattttcctcatttgcttctacctcttgctcctctattccatttccttttgaatcctctgctccttccttctcctctgggatctctgacaagcgatcacatttaaaatcatactttgccatggatttggatattatgggtttagtctctttttcatttccttgttcaatcaatttcctgccataccgtatgttttggtcagtttccacttcatcatcctctttctctccactactaaattctattgcctcaggctgctggaatccatcagctataccctgttgactctcacttgcaccttccatgtaactgtctggcttttctactgattctctttcactgtcaaagatcacatcttgcttgcaactttcccttttcttaacaaaatctttattttcttcactctcagtattcatacctctatctggtaagttgccaaagaaaggactcatcttttttgtactcttttccctttctcttaaatccttcatacctgctatttctgccagtttagtttccttctcactgtctatttcttctgcttctgattccttctgactgtgtcctccatcactttccttttctatttccttagcatcaagttgatcaacaccattattattttcatgtctatatacctctttttgtaaaccctctccatcagtgtcagcctgaggtcccacctggcctgtgtcattacctacttcctcatctgaaaatgcttcgatagtcgtagctggctgcgtcatgaaaatcccttgtgacacatgttgtttacatgctttcccttctttcatttctgacatttcttcatattcatcactatcatcgttttcagtaagagctgtatcctgcgtcagttccccaattgtttgttgtttctgtaaattttttgaagtaattatcatatgtcatactactattagttgacaaggacaacttatctactttaaatactgccaagattttacatttttataagtttaggagaatcaaaatagcaagttttaccagatattttgctaaagttttgttttctttaaggatcatttgtgccactctctagtctgtgatacatctaattttgatttagtaacatgtatctgtgtttaattttcgattcttactacctgccataattttgccattaatcacaataccatcaatatttactctctgcctcttttctcaatccgaatcaatccttacataaaacttcgagattaattttgcaagatgctatttaaaaatgtacacttcttggcctggcacagtggctcacacctgtaatcccagtactttaagaggccgaggcgggtggattacctaaggtcaggagttcaagactagcctggccaacctggtgaaaacccgtctctactaaaagtacaaaaattagccaggagtggtggcacatgcctgtaatcccagctactcgggaggctgaggcaggagaattgcttgaacccgggaggcagaggttgcagtgagccaagattgtgccactgcactccagcctgggcaacaagagcgaaattccatttcaaagaaaaaaatgtacacttttcttatacatagtacagcttagtatatttttcccactttcccgatcatctttaattttcaatttttttttcttgagacggagtttcattctgtcacctaggctggagctcagtggcatgatctcagctcactgcagcctctgcctcctgggttccagcgattctcccacctcagcttcctgagtagctgggactatgggtgcatgccaccacatccagctaacttttttatttttagtagagatgaggtttcaccatgatggccaggctagtctcgaacttctgacctcaagtgatctgcccatcttggccgcccaaagtgctgggattacaggcatgagccaccatgcctggcctaattttcaaattttcatttgtcttttgagtccacaaaattcacaaaataaataaaaatgtaaaatttgaaaaaaatgaatagtccactcctagaactgaagaaactgcacatgagatgttttttatctataaactaaataataatgaatatatttttcttttctaaacaaaatcttcatgagttttcaaatttttgaccttcttccttgcattgattatattatttaattacaataatttctataaatgaaagaacactaaggaaagaatattaagtgtaaaatgtaagatttgtacaaaaactatgaaatcaaacactgacatttgaataatacattaacaatacaaaattaatttcctgctggacaaaataaggcaaaaccaaattgttgatctaaattctacaaacaagctaatggatgcaaatatctaatgaatttgggtctctggatagtaaaacctcactaattcaaattttataaattgtgatgagttaggcctaggaagaggttcctattgtgccaaagaaattattaaaacatgacaagttaaaaattaacaagttaatacacagaaatagtataataaatcttttctcatttactaaagtaggcctggtagggcctaaacttaaaaagactatagaaagtataaaatatatgtcagcttaaaaggaattgctttccgtttctggctgttcttgctattgctctttaaaaagtcatgattcttttaagagccctaagagaggaaggcccagttgccagaactgatttctaaaggcacatgcctttctttccctagcacaataaagcagcccagaagagggagagcctggagtctaagggaagaggaaggaaagacacaagaaaggtgtctgcttggaagtatggtcagtcaaaaatcagtcaatattcattgagcttctacaactgtgttcgaacagctctcccatattcaaaggaatgctgttattcaccatgcctttcagtattatagatagaacgaatgaggactagctctaaattttaacaatttagtatgattctcttgcacttcagtgacttcaattttaagagttttaaacttgaaaacatgtcaaagacactataaatagaaactaaatattttttatagacttcttccctcaacttacatttctccaatttactttcctaatcctctaatccctcattcattcattgcactagtccttaaagccaggaaaagcaaaggatttcagggcaggcctttatctctctatggttgtgaaaaccacagcctattcccttcttttgcaatttgttattcattaaaagtctctctttcctacccatgaacagtctctaatttccaaatgtttaattttatttttatgctatcaatttcttgataaattaaagcccaaccaaatattggaaaaggttatcaaagattttcactaaaatcacaaaattttaaaactaaaaaagatattaatatcattcagtaaagtcagcatagtaattaattcaaagtcatactcaaccaaagtcagagggccactctatcaataaatggtagtcttttcctatacataagaactgcaatcataacctatggcttgacagaaggaaaagtatggctattataacttaagttaatgatcccaaagagcaaatttcagcaataaaatgcttccactcttgtttctttacagaaaatacataccatcagaacaaggcaaaatggaggttatctacattgtatccctctgtcttttaaattctaaagtaagtaaatgcttacgtttcttgtgttctttccaaaaaccatccaaaaaattaacttaaactgctctcaccaacaataacgaaaataaatcttcatattataccttttgtttctgaactggtgataattttaatgacttttcattggaattcaggctcatgatgtgtgtctgaaataaataaaaaatatatattataaaaagaatacagtatatatactatatatttgtatatagtacaaatatatagtatattttcaattatatatatttttttatatatatatatatataaaatgaagggaaaacagttcagatagtaatagaatccgctctcaattgccatactaataatgtgaggatcaaaacaaattttattgtatgtgaattatacctcaatatagttggttaaaaaataaagtaagaaacgagaaagacgctttcatgcatataagagtataggaagtatacacacattcacatacacaatgaactaaaattcaaactcatatttagataaatagataggaaatcattaccatgtttaagatatcagtagtttctccaaggctttctacagttgaagaattatctatctctgcttctttggtcatttcatctagcaaataatctgaatgattaaatgggaaaaaggaaatccagatttcaacagaaaagtgaaaggcaactggacagaaaacagaaattattctataatataaagtgtaggtataattttactaaaagtcctttaacctcatgtcagggaaattgaaaagaattcattcacaatgacataggttttaaaatctttgtgaaagtttaaaaacattgacaccaattagattacaattgtttcattcatatgaacaggcaaacactattcccttgggataaataactacccaggtatcaagcactgtaatagctagtcctaagaagggccccaatgacctacaacgtcctggtgttcatactcttgtgtagttcccttgcccattataccaggttggtccgtatgtgcacagccagtaaaataaagcagatgtaattgtgatagcattatggcttctgttttggttatacacgtatgcgcacttgtgctcgctctggctctcttgctctctctctctccccctccacccccagctacactcgtgcactccctctctttctctctaatcacttgctctgtaggagtccatgttgtgagcatctcaaggaagtgaggcctcctgccaatggccatgtgaatgagcttggaagtggatcttccagcctcagtcaagccttcagataactgcagccccatctgacagtgtgactgcaaccctatgaaagaacctgggccagaaccacccagctaagctgctgctggactcctgactctcagaaactgtgtgaaataataaatgctttttgttttaacctactaagttttagggtcattttttaaatgtagcaacagataactagtataagcacctagaacctttcacagaaaactgcaaggttattacatcataaagtagataattaaaagtcataggctctacttgactttacatttttctcagtttctcactatgccctcattgatcaccaatacatttggacgtagctccttaatgaagtcttcactaaaaaatgacagtccacactgatccctcccctttaaatccactgaattgaatgagcaaataactatttggtatttattccatgtgtggtaatctgcagaatagcaacataagtaattgctaattcttttttattttttatcgtctatatttaaggtataaaacatgtttgggtatacatatactaataagttcattaagtattagcaattgcaattttgttgtttgctgttaaaaaattgtaattgctatttcttaatgaagttatagtctatgagaaattacatccgtatgttggcaatcaggaaaagtttcactacagaggtacatagaaagatgagtagaattagaattctgaggggcagagatggaggtgtaaggggaagacaatgaagcccattcctaataaagcagcagaacagtagtctcagcaaatgagtagaggaaagaagcttgtcttgaaggcttaccaaatcccagaaacatatgcttttatatatgttatattgaccctacgacaacaaggaaggttaagtattatatcctcattttgtaaatatagaaattaagtttcagtgaccgttggtatccagtgtcaatcttaggtctgtctgactccacagctcttgttctttccactaagttagactgaagagatcagtctgatcaaaattaagagtcagcaaactttttctctaaacggccatatagtaaacatcttaggcttcctgggccatatggtctctgtcctaactaacctatgacattgtagcagaaagcagccacagacaatacataaaggaatgggtatggctgggttccaataaaactttatttataaaaacaggtggccagctagatttggcccacgagccattatttgtagactaccataatacattactaccataatactacctattaccaaatgaagattgtaaggaaaagactactgagagataaagctagaatttggaattatatgggaaaattaacaattattttcataaatattaggaattcactgaagacactggagcacatggaaactgaattgcacctgaggaagatcaatgtggaaagtgttatgcaggatagactggagaaggcagagaatataggtttggaaaatacatagcagattatttaagctgatggccttgcctcagatttgactgagaaaacagaagtgatcatatccgatccacttgatcttctcaccaacaaacatacacaactacctatatttgtacccaagttctcatttgcctgttaaaatgtaggatgtgtttttcctgttaccaaagaccactctctatgccggcccctcctgttttgcaagagctttgcaactttccttatactttctctcttctgtgctctctctccaggactactggctcattcattaccatataaatgtgctccaatattttctattgagcccacatccccctctagctgccagaccatttctctgctccactttatcagcaaatagacaaaggaattatctgctcatcttatctcctcttcaatccctcattccccattcataactcaactcttaacactctggcttcttccctgatcttcccctagaactgctcttgtcgaggtcaccagtaaactccattataccaaatccattggatacttctttgagctattttcccttgatctttgagcggtactttgcattcacgacactacgctgccctaatttcccacctcctgccttactggctgaaaaagctgaggaaggcttctttgctggctcttccttctctacccctcaaatgttagatgttcttagggatacattctgggccctcttctcttctgactctaccctctagcaggtgatttcaccaacatccatggattttattattattttaaatagagagagggggtcttgctgtgttgcccaggctggtctcaaactcctagcttcaagcaatcctcctacctcagcctctcaaaatactgggattataggcataagttaccatgcccatctcttttaaataccatctctatgttgatggcttccaaatttatatttctagtccagggctctcttctaaactttaggcttgtgtttcaacaatcagcttgatatttctacttggatgcctcacagatctcaaatttcttcctcaaacgtgttcttagtttgaggcttagttcttaaatttcttcctcaaatgtgtcaagcttcctcttgcttaggaatcatccttgattcctcactttaattcacacgtatgtgtggtgcattaataagtttagcaagtccggttggtttttatgtctataatgtatttcacatcttccctcttttctttttcttttctccatctccactgcaaacaccttggtccatacactatcatctcctgcaaagggctcacaagtattcttcctatttctagtctggcctctgtataatctatatggaggtagaagtgatcataatcatctcaaagtagaaataggattggaacacatcagtctactgcttaaaatcttttaatgactttctatctcacttaagaaaaacattcatatcacgtaggtctctcacggcctataaaaccgtaaataatttttcaccatctctttctccaatactgctttatcttaccctttccctcactttctagccccactggttgtccttttcttcttaactgcctccaaacctttgtctatattattttctttgcctgaaatacatctagtctccctgtgtagccatctctttcttatcctttagcttaaatgacaactccttagtaagatatatcctgatccactttcctccattataaagattgaagtctgtgaatgatttagaaaaagttaaagtatatgttagatacaacttccaaaatgttttcttaagagagtgttagcagtcacaaaaagacaagagatggcatttccttttgatctagctacaaaatcatgcatattttcacattcaaatctctgggactgagaaacaattttccctaaaccataaatgtattttttccttgtacacactacatactgcttgccagaatctactactttttccatgtccagggctgaagagtaccattagacattgatcttatttcaaaagaaaacatacaaaagttgtgggtcaggtgcaagaaatcagctcattatcaaggtcctagttatatataatatcccattcccatggcccacaattcttacctgagttcccaatcctttattacctcaaccctttgcctagcttcctgatctcaaagatacacaaattatctgttcctagtccctgattcttagtccctgatgacaggtttatcttcttaatttcaaatttactgcttactttctgatctcctggtcctggtttcttgtcctacccctatcaaatagagaaatatgttggctattacaaataaaactgctatgaaccttcaaaaaaagaaatatgttttgaaacttacagtaattttcagaaaagaaatgtctccttcaaaaattatttgccattggccgggcgtggtggctcatgcctgtaatcccagcactttgggaggccgaggtgggcagatcacaaggtcaggagatcgagaccatcctggctaacacggtgaaaccgcatgtctacaaaaaaaatacaaaaaattagccgggcatggtggcgggcacctgtagtcccagctactcaggagactgaggcaggagaatggcttgaacccaggaggcagagcttgcagtgagcccagattgcgccactgcactccagcttgggcgacaaagcgagaatccgtctcaaaaaaaaaaattatttgccatttactttaaaaaatatatgtgtcattggaacaataattttaaaacacaggagaatccctaaatttaattaagagagaatattccctctctagatgtcctgcagtaacatacagacactcctaagatacacaaatatctctaaagaaaattacttagaataggtatagaatagtgaaagagctgggattacaaattaaaacatgaaatctgtatctaataggtagtgacgcaaaggtattaatattaatcataacaacatttactgaggtgtttctagaggtgctgggctcaatgctaattattttatatgcctgatctcactgaatcctcacaatcactttctgaagtcagtattattaaataaatttcaaagacaaggaaactgaggcttagagaggttaagtaactttcccaaagtcagccacacagctagtaaatgtcaaaactggcttttgaccccagtttaactccatagtccatgctcttaaccgctatgttatactgcctaaatacagaatttcacatagatccagaagacctgtattcaaattctgaccacttcgtttataagctgagtgaccttgggcaagtcacttgatctcttcaagccttgcttttctcatctctaaaatgaagactataactccctcctaagttcatcaagtggtttcagggtttaaaggggataaagttaaggaatgtactataactgttatccactgctctataaagatatgctgctgtggttacatggcagtcttaggagcactgatggtgctttctacttgtaaggatattcccggatttgagttcaaatgagtgatgttaggctctaaccagggagagaacaatttaaataactggagaaaacatcttaagataaacataaaaactacaggaataaaaggcacatttatcctgagagcagacagagtagcaaatgttacctggttcctctggctgcatgaggtcctgttcagataagacactctcttggaggtttctctcagaacatcgtggaaagactgaattggggagaaaacaagcagaaaggccaagagtcccttctattggaggtagtgttctcctcattgaaaaagaatctggagacctctcctttaaaataagcaggttaaacaaactatttcatgatgttatatatttaatattgatataaactttcctaaaagttgctaaaatatttaagagaaagttcaaagtatgccaacactccacaacatttacttcttaataatccccaaaggctcaaaaacattttgctctgttgtctctgtatcttagttgctctaaatttcaatttggaagctttatttttcacatgaccagggaaaagtgtgtgtgcattttctctacactccctaagaaacaaaaaattacttaggagatgtaaattaacaacaactacaaaacactgatggggtatttctcaacttttccatatatgctttttcataataaaacaccagatttaacctttttacttcaaaagaaatatgctggctattacaaataaaactgctatgaaccttcaaaaaaacatgttttgaaacttatagtaattttcaaaaaaggaatgttaccttcaaaaattatttgccatttactttaaaaaacaggtatgtcattggggccgggcttggtggctcatgcctgtaatcccagcaggttgggaggccgaggctggtggatcacttgaggtcaggagttcgagaccagcctggccagcatggtgaaaccccgtctctcctaaaaatacaaaaaaattagccgggcatggtggtgcacgcctgtagtcccagctacttgggaggctgaggcaggagaatggcttgaacccaggaggtggaggttgcagtgagccaagattgcgccactgcaccccagcctgggcaacagagtgagactctgtctcaaaaaaaaaaaaaacacatatatatatatgtcattggaacaataattttaaaacacagaaggaaaatctctaaatttaattgagagaatatttcctctctctaattgaagtccttattcctttgttttcccatttcattgtttatagtatataagctcccactgctcatgaggcttaactgaaagacaaaagaatgtagcattatataagataattaagttctacagatttctgaacaacataacattgtgcctatagtcaacaataccgtattgcacacttaaaaatctgttaagggggtatatttgttgtatttttactaccataataaaaaaaagcatataacaaagtgaaagtcagtccacatgcagttgaaaaaacaattcagcattcaatgtgaggtgataaaataggactataaaaggatgcttttatagcaccattgtctatatgcaaaagttttctataatttaaattttctaatttgtgtctttaaaaaaagcattaagcttttctgaatttttctgaattaactctaaaagtttgttagcactcaactctaataattttatgtagcaaatttatctgagaagaccctttgatttaaaaagaaaacagatttttttcttctagttttctttgcagtgctagataatactattatacagaataggccacaattgtaccctctctcttcgccgcatacgtgctgatagagtcctctgcagtacatttcctgaggttaaactgctatacggcagaaaagtcgccacagataagcaagtatcatttatttcatcgaattcaatttcttttgccacaccacgatgaggagcagcaaaaactaccatgtgacatccaccacaagcaacctgcagcataaatccacagaaaaactcatcaacattggcttcaaacacaaatgagtttttaacagttatcagctgtaagacatttatttagtggtaggcttcctagacagactggcttggtgaatctctctgtctatacgtatgtgtgtgcacaatgagaatgtgtacacaatatgtatacaataggtacacaattaccatacatattctttaaacattgtgattgaaaattagaacaagtttaatccaccattttactttcaatttaaaataatatagagaaaaaaatacttggcaaattacatttctccttacagttagaaaatgttgtattttaatctgggaagaacattaaaaatgtgaaaaattactcagagaagttctactagaagattttttttaaagtataaatcagtctcttgagctaattatgtctctaagccttctttatatgaacattttctaagtttaatgcttaaaagtccttagaggaaaataaatgcaagtatgcgtgattacttgggtgatgacagaacaataaaaaatgaaatcagcattcaaagaattttgagaaataaatcattttcaagaaaatgctaaaaaaaaaacccatagtgcagtattttccgtacataggttctagatactttataatgttctatttttccttcataatactttaaaattttaaatttatatatatttttgtatatcccttttaaaaattataagactgtaatgaataagtcctcaatgaatgaggtcctggttatttcgttcatcactgtatacaatactttgtatttcttttttttctttttttttgagatggagttttactcttctcgcccaggctggagtgcaatggcacaatctcggctcactgcaacctctgcctcccggattcaagcaattattttgcctcaggatcccaagaagctgggattacaggcacctgccaccacgcccagctaatttttgtatttttagtagagatggggtttcaccatgttagccaggctggtcttgaactcctgacctcagttgatctgcacgcctcggcctcccaaagtgctaggattacaggcgtgagccaccgcgcccgaccagtactttgtatttcttatacttagcacactatcttacccatagtaggctttcattaaatgactgtcaaatcaataaatcaaagtgttccatattatgagacactgagtctctggaggacaaatttcagtattatcatcaagtaaatagaattttcaaaagtctaaacttaactggcaaaaatattaagaaacaatacaggtatgatgcgtgatggtgacgtgacactgaaataatacatccttaacctaagaaaatttagccaaaaaaccgtatcttcaaaactctttattttttattttttttgagacagagtctcactgtcacctgggctggagtgcagtgacacgacctcagctcactgcaacctccaccttctgggttcaagcaattctcgtgcctcagcctcccaagtagttgggattacaggcgtgtgccatcatacctggctaatttttgtattttcattagtgacagggtttcaccatgttggccaggctgttcttaaactcccgatctcaggtgatccgcccgccttggcctcccaaagtgctgggattacaggagtgagccaccgtgccctgccaaaacgctttgtttattatcagactttctgttgtgcaggatttgagagtctaacatttaattcagcaaatatttattaaagactattgtgagcaaggtactctgctgggtgctacacaagatacaaagcctgcgggcatggcacagtcccagctttcaacagatatatgagaatgaagcagaagagacaagatttcagcaaaaaggaagaggctaaaggaggaaaattaggagcaacacattttctgaatggcataatgtctgacatttggcttttaggaaacaagtatatttattagatatatatatgatactcttccatacaaacataaaattacttattttctatgaaatactgaaagactcaaatacagtaatatgaaaatataaacagggaaatgtgatgcccttaccaatttaactataaacctcaaaaaattagagcacaaagtaggaatgaagtgattggtaaaattctccagtccaagtcctaattttccgtggcgaccatctccaaaagtatacataaggccgatatctaaaatgcaaaaataatgaagagaattataaaagtgttacttgtatggatctatttgtaaacagataaacatgttaactcatactgcaattataattatccccctcaaattctgccttgaatttactctattgatctttccacactctctatggtctctgtggtcctgcatgtaacatcaggcaataaatattctgagaataaatcaattaaccttggtggtttgtgaagttgatgacctgtcacgcaaggcagtgtgtggagcagcagcaatacagaatgagaatttgagatacacatcatatattccaagggaaggagaaggagatgcttgtattctgacccctacatcccaacacagtctattttccttttccctgaggtcactgatagatcagagtttctcaaccttggcattattgacatttggggccagataattcatggtcgtgtgggtctgtcctgtgcactgtaggatgttcagcagcatccttggcctccacccactaaatgccagtaggacaactccattctgcagtcatgaccattaaaaaatgtctccaaacgttgtcatgtgacttggggagtgggggatgcacaaaatctctactactggcttagcttaactaatctggctcctgggctgtggaatactgttgaagtaaatgccataagccaaaaatgctaactaattcctataccaaaacctgggtcccctctgaaactgggcccacaatgatgatgagtaatcttgtcacttctcgccagttagtccttttgcttactgccatagcagctattacgaaccttcacactcctttcttcaagccgctccatctcaactggggtaagtgccagggaagcagaagtaaggggtgttaatatggttcaaaggaggggaattttcctctagtctggggattagggaaggctttcaaagggaaacctaaaggatgagtagggcttagctgcatgaagaagggagcaaagaatcttccaggcagagtcagcagtacatagaaagcctctgaatcaagagcaaacgtggctcgggcaagaagctgaaaggcaactaatacccctgaagcactaaggggagagtggtaggagatgagtctgaagaggtgaaaagggactacacagagtgtcctattagttcagatgaaggatttttgaagttttatcttaaggacatttagaaggaaaatgaatggttttaagctgggaaacaactgggtcacctttggggacttctggtttaagacggcaaagtgactgcatactaagcaaatccaagagaactgaaaaatcatcagaaagaataatataattcagtaaggtggcaagtataaaaatcgatttacaaaaataagtagattccctgtaaatatgtaagtaagtgctattcagtgtttggactctttagactacctttttttttttttctttttttttttgagatggggtctcgctctgtcacccaggctggagtgcagtggtgcgatctcagctcactgcaacctctgcctcccgggttcaagtgattctcctgcctcagcctcctcaatagctgatattacaggcacgcgctgccatgctggctaatttttgaatatagtagagatggggtttcaccatgttgaccaagctgtagactcttacaattcttactattaagtatttatgtccttcttttatatctgctccttatcacctttatcccttcttcctccttcttttcaacctgatttctttacccaaatgttttttaaggtttgccttttaaatttgattgtcttttgcctgaaaatataaaccctgatccaagctgcctgatggcactttcaacctcagagagcttttaaaaatatgagccactggctataatggggaactggcaagagcttgcagataacccactacatacttctcattagtcctggaggaaaaaaaaaaaaaattccacaccacttgccctccagggacgattgatgaacaaaaaggcaaacaaagttaatgttcaattatttgtgctataactctttttatcaggagtaaaggtactatgaaaatttaactaaatattcgaattgtatgttagatgacagattaaaaatagtatgtatctactattagtggaagattagagttgatgaaaaatgacagtaaggacagataaagtgacattaggaccctatagttaagggatacacaacaactcttagtggatgatgaatgaataatacttttcatattctatataatgctatttcatgatacattctcaagaacactgatacttgatcatgggcaggtcatcttctctgaaagcttctttggggaagaagaaacagtatatcttgcatttgctgattcctagtttccctagccagataccattagatgagcagtagttttttcaggagctttttcatagcagtagctttttcaaaaagaaggaaaaaaagtagaaatactagtacatggattacgtcaatacactagatgatttctgactttccaatgcttcacttcatatttagacagaaatagtgaaattatatacccgtttgtcacaaagcattgaaaactgtggactatatcaattacctacatatatgtgactgaatcatttaggggagaatctttactgagtcctatattattagcagcacatagttttgaggctgagaagtgggctcaaaggaacatttccctgcatgaaggagataccacagagtggaagaaggtatccacttagtggtctctgagggtcccttctctctaacacgtagaaagagaaggaaaggagtcattcctgaaaacgcctccaggtggcaaaaacataacaactgactcggcctgaatgcagctctgtcagactgaataggaagaatgttttaaaataagtttttgcttgtgggatttttccttttggcctgagtagaattaagagccttcaaaatgatataatttcaaaaagattcctgttttctgacaaagaataatactatggtctaacttctgacatcatcggcctattgtgaggttctaaatctttggatcatttacatttattctaaattgaattaaaataataaaaagttcacaactttatactttggaatagtaaacatggaattccatttttctcagccattaattcctttacttaagttagatacattcatttcacatataatttattttgtaataaaatatacccagttctataaatatataacagaaattctaatccatacctgttatcaaagctgtgtgattttctccacaagaaatataacttattgtttgatccctaatattctcaatgactttgggttctgaagtttcaaaaagaaaagtgccaagacccagctgaccaaattgtcccagcccaaaggtatacacagcattctctgaaaggaaaggggcaaatacaagacaaggattatggaagcagacactgttaccatcatatctggaaaaactgtcacgttcaaccttttatagtgaaggttaagtgcctctggggaaaaaaaaacatttaagaatacttaatattgaagtataaatctttcaatgatgaaggaagagaaaaatgaaaaggtacatcattataaaaattatgacatgggtatgattttatcttttatacataaccatagttaggtaagtaacaggtatgatacaaggcacataagtcagggaactacctgaaatgtccccataattacgtcggctcaaaaagtaccaactgttggccggtcgcaacggctcacacctgtaatcccagcactttgggaggacgaggcgggtggactgcttgaggccaggtttgagactggcctggccaacatggtgaaaccccatctctactaaaattacaaaaattagttgagcatgatggcatgcatctgtaattccagctacatagggaggctgaggcacaagaatcgcttgaacccaggtggcagaggttgcagtgggccaagattgcaccactgcactccagcctgggtgacagagcgacactccatctcaaaaaataaaaaagaaccaactgtcattaagctaactcactacgtcaaataaaaaagtgaatagtgtctcctacagaaaaacttcttccttttaaaagcagtttatgcatcacctaaggtcaggagttggagaagagtctggccaacgtggtgaaaccctgtctctactaaaaatacaaaaattagccaggcatggtggcgtacacctgtaatcccagctactagggaggctgaggcaggagaatcgcttgaacccaggaggtggaggttgcagtgagccaagatcacgccactgcactccagcctgggcaacagagcaagactccatctcaaaaataaaataaaataaaataaaataaaataaaataaaataaaataaaataaaagtagtttaataatctatcttataaaacccaatttcagagaattgtcttgagaattaaaactgatagggcatatgctagatttattcacaagtaaagcttcttcactaggaaatgcaactataataggaggggaaaagcttttctttatattgatattttgaagtgattccaaaggacttccagtaactcagtaaatactacgtcatatgttttctagaaatgaaaaagtacaaaaacaggatacatgagtggtgatgaaagggtccttttagagacatcatgctcctggctgctgcattaggaagcgcagtgtcgattatattagtcacttctccttagtacactgagttttgtactttgagtttagtacattgagtttctcctattacagcaggaagggcaagagcttgttattcaggccagaacccaaacattcattattactagctgtggcaagcaggtgagttacttagattctctgatgttataatccctatctaacagaggtgctgacaggattaaaagagaaaacattcaggcagatttgaaaacataatatgacatactgttgtaaagaacatttttctaaaaagtatctaatcaactcattctatcaatgggggttacaaatgaaaacataactgtctattgtcatgtggttttacaattttttctaataaaaatgtttgcttcataaataagacatatagatactactcctttaagaaaatatgctgtatcaaagatatgaagccatattgaggcaatggcaaaacagatctttattttaatattaaaaaaccatcttagtttaaataataatcacatggcatatttccagttctaaatgttcagcttaacagtagaatattgggtaaattaaagcaattatctatctctagctgaccaacaattactctacatttcttaggctgtctgattttaattagcctgtgaaatgaggctgtttaggcagtctgaatcatgttacagaagttttgttcagtatcctggtaggttcccattcaggtgcttggatattagtgatgacagcagtttctattttataaaaatgattgaaggcgctcttatttaaggacattatatttaacaaccaatagaatttttggccatatcacctttgtgacatttaacaacataatttaatgttaataaataatattacattaggaaaatagatttgatcagttagcttcagattaatattactgtaatttcacagaatatatttgatttcagaactaataatttgttaacctgtagaaaacttaggtttatccaaacataatctgagaagttaagataaattctcatttgcctcaggacccagacttcattgtgaaccccatctcacaactggcctttcttgtgtgttggtaactgctgtggacgatttacaaaactacaaatatcactctgcctcacttagtgtgtcccaagttccagcctcagactttttccacagtggtccatggtttccctgatcccaaggagaaactataatcaccctatcactacaaccagttttattttctaatctatcacggtcatgtgcaaatattatgttttaaataaattcatcagaaatgaactaaattgtttttaaaatagtttaatgaatgatcctctaatagatttttaagataagagttatagacttttgaaaaacaaggctgggaaggtccttcacagaaacacctaatccaagtgcttttctttagtgaaagaaattggaacaggtgattagctattctttccttaaggtcttacaaaatattccataactctcttagcaatccagtttagtatttagtcacactgatgatcaatatactcttcaggtccatttcttcatcagctaggactaaatatttttaaaattctgcctatactgtgctccagaaccaggttcctcaccagggctggctcataataaagctctcacaggtccatggagaaatgtgaaaaacaggcaaagtagtgaaattttcatacatatacatttatacagtttaaggaggtgccctttattatatacaattaagagttttttattttgaaaatgttccttattttatgatatgatagtgcagtcatgtttttcaatgcccatatttaagcaaacgtgaatcagaagctgacaaccatctattggttctcataattttttaaactcaaattttagattattctctggattgtaacacaagctcttcactgtttacaaagttatttatgaactgtaaaaattatctctccatgtttttttccctgtattaccaagtttttctcctgtattcccccattcaatgttggctgccacaatcagaaaggaaatgcaaggacacttctttcttgcatctgtagtagaaatcttagtggcaaaaaataactgttccaggtctgtcaaatagatgcatctcataatttaaaaaactttactggtgtgtgagatccgtaagcttgcaaaaatctggagagagcaatcaatttctggaaacattatacttaagctcagaacaaagtccacagaaagttaaatgtctttaaaaccacacgaaaatatcatccttaagtgcatttattttaaattaagaatttaaaattaagaattgagctttcattaaaagtatcatagattatcttgttgctctttatagaaaaatgttttataatgaatggttaaagacactattatacaatcaacatttgtatctgttaaaataaccctgaatgacctattaaattaattctttctatagtctttgtataaactagagaaaatatataacacataaagttgcatttctgcctatagaatgaattttcagataatgtgtaaaaattaatttcaaagtttaatttttagaatattttcgaaattatataaaattcactttttcagcaggaattcaaaaacatcttaaacctcagaattatttccaaatttagagtataagttttgaaaaaaaattatttctaacttagaaaagattccatctagaaactaaagcttaataaccacgactggggctagaacaggaagctgaggaaaagtaacatcagagaaaaaaacataaagataaaatattattcacttacctggcaacattaggcatatcatcttagaattggatattattcaaaatttgtctacaacatttctaactttgggctactaaagattaagtggtgacttcacaaactgttaatttttttgtgcaaaaaatataataataattcactacctaattgtattatgtacattactcatctaaaataaatctaatgttgaaaaaatttggaagcatcaatttagtaaacatattagcaagtagtgagtatatttcaatacagtgattagaatcctgagaaatgacatgtcataacaaatatgaaattcagatcccaaaagtaacattaaggtcctaactttcttttattatctgtaatttaaaaccataccactttttaatgaattactataacagaacatacaactacaaagaaatccccaagctacacattgtaaatgtcacaaagaaaagaattatcaatgacatatagaaaatagcttgaacaaaaagcttctccaaaagaaggcatttcaggaaaaatgtcaattttagataaatatagaaaacatatacatgagaaaaattgtttgtccctgaaaatgagctaaaaataatgtaatatgttgccattaaaaatgttaaggtcaggccaggtgtggtggctcacgcctgtaatcccagcactttgggaggccgaggctggtgaatcacctgaggtcaggagtttgagaccagccttgccaacatggcgaaaccccatcactactaaaaatacaaaaattagctgggcatggtagtgggcacctgtaatcccagctactcaggaggctgaggcaggagaatcgcttgaactcaggaggcagaggctgcagtgagccaagatcaggccattgcactgcagcctacatgacaagagcgaaactccgtctcaaaaaaaaacagttaaggtcatgaaaatgtaaattatgttagcagaaacaattcaacaagattcattttttttctacttaaaaaaaatattccatagaccagaaatgtatattaagtacaggaataaagggtgagaatcttttttttgtttgtttttctttttgttttgagacgaggtcttgctctgttgcccaggcttgagtgcagtgggacaatcacagctcacctcaagctcaacctcccctggctcaggtgatcctcccacctcagcctcctgaatacctgagaccacacctggctaatattagtaaagatggggtttcgtcatgttgctcaggctggtctcgaactcctgggctcaagagatctcctggcctcccaaaatgctaggattacaggtgtcagccattgcaccaggtccaaaaagtgagaatcttaatggaaagagatgcaaaggccacctgacacgaggtatctaagagtcaaactcatagaggctaataataaaatggtggtcgccaggaattgaggggaggccggaaagacgagttgccgtacagtgggcgtgaagtttcagttactcaagataagtttcagagatctgctgtacaatggtcgtgcctatacataaaaatactttattatactcttaaaaatctattaagaaggtagttctcatagtattcttaccacaataaaaaaatgaacataaaaaaaatgaacattaaaaaaatttcattagccaccacagaacgcagggaacagaacagtggactccacacatacccgtgagaaccacagtatgctctccaccacaggctacttggatcaccttctccggaatttcagacaccagctggggtgttctgtgattgcccaggagctgattgggaagacctaacttcccattctcaggttctccaaacacatatagctcaccatctgctattgaaggaaaagtatagtgattagtgatgacatacatatgaacaaaaagctggtcttaccgtcaaaaaaaagttttgacaaggatcacttaatacatttgacctttcttgagatatttttactgtatgataaagaaataaagctagattttcttttccccttgattattttaatccaatcattttcatgaaaaattcatgactaccactactaataaacaactagaaaattactttagtgctttcacaaaagtgaagaatatcttgtgtcttttacttacttaaagctcccataaaaacatgaattttgtcttgctccctatggtatccccaaaacctagcagtgtctagaacaagcacttaatatttgtggaataaatgaatgaataattgctttatatgaaactggttttagaaaactcacttatgtgtgcagtaaatatgttaagtaaatcttaagatagcagattttacccatttagatggcacttcctccaaagactcttaccaaggagttcctgacacttaatcactgccctgtccatactaacgctattaatttgcttctttattacatttatcacactgtattatgactgtgaacttcttgaaagcaagaactttcttattcatttctatgcaattaactgagttctataaagtagaatttaaaaaccttgtgtaagtatatgatccaatctgaagaatgacatggaacatatcaccattggtataagcaaagagacaacagagcagatctgcttgcttattctttgcaagtctctgagagaaccatgattgatccttgcccaacccctgagaaggtggcccctggagtgttctttatgtgaatgattaatgattttgttatatataccagagcaatgaactatgccagattaggtttgtcagggctgcttgcacaaacatcaacattgatgatgtgcacctggcttcattattgagggtcctgagtttcagctgctgtggccagttgctagcaggaggtgcctacatgaccagccccctaaatcccctagaagcaacagaatgggcttccctgggcagagacattccacacatgtccctgtagttcactgctaagaaaacatgccctgtgtggtttcctaagagaaagtactaggaagcccaagcttgacttctctggactccactgcagatgcttatctttttcccactttttctttttgctttgtatcctttgctgtaataaatcttattcgtaagtataatcgctattgaagactgtgagtccttctagaaaatcacagaacttcaggaaggtgtgggacagccaatgcacaagatatgcaccacttagaacttgctcaaatactgtaaacacagctatattgattttctgaattgatctgcacagaaaatgaagttttatggaccacagttttctatgaagtatttagcaaacactggcacaaaagtggtgcccagtaagttagcacccttccattttcccatgcttgttgcctcccataggaaactggttcctaagtcctgatgagtctctctccatttctgtctatagattcctgattccctttacaccttaacatgaattttcacctggatcaagttttccaaatgtctttcctacctctagtctaacatacccacacaatatcagatgcatcttccaaaaacaaggctctaattatgacacttccaaataaaaaaaaaatacatgtatcaagtacaaactgcagactgttacaagagaccttccatattaggttcccggactactaaccagtcatatttctatctactccccaacctggtgactctcttttgagtcacatcctcccttgggaatttgatgacagctctataaaaaaagtacacatcccagcagggtgtgatggctcatgcctgtaatcccagcagtttgggaggccgaggctggtggatggcttgagtctaggagtttgaaaccagtctgggcaacatggtgaaacccagtctctacaaagaatacaaaaattagccgagtgtggtggcacgcatctttgtcctagctactcggaggaatgaggtgggaggatcacttgagcccagaaggtctaggctacagtgagccgtgattatgccactgcactccagcctgggcaacagagtgagacctagctcaaaaaaaaaaatgcacctaccaaatttagcatatcatttcaggggtttacattcctttaggatccatgatccctaacctctaaacaaacaacctctaaacaaactcaactatgcaataatctccaaatacatgatttacttttctgtctctatatctctgcacatgtttttgtctctgcctggattgttcttccctcatctctgtctctctcagagttgtttccatctttcatggttaatctcaaataccaccctttctctgaaatatgtcctgacgcccctaacaagaaataatattttttctttcttgttctcacgtaagactctgctatcaaatgtcttacgttaccaatcatggtctgctgtatattgcagttattggtctagcacagtagcaaaaagtatgtgctacagagtcagactgccttgtttgcatgtggattctgccacttactgagtcatactgagcaagttgttcaatcactgggcctgtaacatggggataaaagtgcctatgtgatagggttgtttcataggaataaccgaattaatgcattcaaaggcacatagaacacataatcagtgcctggtcattattagttgctaccacatcctcctcttcctcttgtatatggagagaaactgcatgtcagtagaaattgttcaggcttttagaactggaagactggagttcgaattctgattctgcaactcaatcgcagcatcaccttgaataaaactgtgttctaaacctgcctgcatatatggaatctcagataccaccacctctctcccagagtggttgggagattaaatgaaatatattcgtacttgaaaatgctttgtacatggaaaaactatacatcctatagtttgactgtaaacttcagaagggtaggtactacattttaatcaacttggtattgtaagaaatatcatttaaaatgacttttacatagtaagttgatgaagtttctcacagtgtcgactttttaaagtaaaatgttttacctataaagcaggggtgtccaatcttttggcttccctgggccacactggaagaattgtctttggtcacacataaaatacactaatactaacgatagctgatgagctaaaaaaagaaaaggtctgtgcataaatctcatgttttaagaaggtttacaatttgtgatgggcggcattctaagccatcctaggctgcgggttggacgagcttgctgtaaagggttagaaaagatatttcctgtagctatcagtaggaccttccttaaaggggaaggtgagtgcttttaatccatataaaatgttttatttaattccaaggtatttttcttatttatatataaaaaataaaataacatttatcacaaagaataaataggtcatttcatatcaattatatctacttcacttaggcctattaatttttataaaatctggattcctcaaactctctacctggctctgacagctaccttccccaggattctgatcttaagcacactgccaagtctctattctccagtatctgaagattgctccacaaattcctgcccccagttcccataaccccaactcatttacttatatcccctattgtactacacctaattcagtgaatcactggttaaaatgctcagacccaaccattaacatatcagatgaaaagacacagcaatcagggataatacctgaaaactccatagattttatttatctataagatctaaaaattgaatattttatataatttataatatgaacttgaattgagaacatgaatttaaaacacgaacatgagcatttaaacatattagtaggtgaaaaatctgtaggaagtcttaaacataactatcttagtaatatgttctgtatttttattaggaaataaactattctgtttggaggttcctcaaaaaactaaaaacagagttaccatatgatccagcaatcccactgctgggtatatacccaaaagaagagaaaccagtatatcaaagagatatctgcactcccatgtttgttgcagcactgttcacaatagccaagatttggaagcaacctaagtgttcatcaatagatgactgaataaagaaaatgtggggccagacgcggtggctcacacctgtaatcccagcactttgggaggccaaggagggtagattacctgaggtcagaagttcaagaccagcctgaccaacatggtgaaaccctgtcgctattaaaaatacaaaaaaaatagctgggcatgatggtgggcgcctgtaattccagctactcaggaggctgaggcaagagaatcgcttgaacctgggaggcagaggttgcagtgagccgggactatactactgtactccagcctgggcaacagagcaagactctgtctcaaaaaacaagaaaaaatgtggtacttatgcacaatagagtactattcagccatgaaaaagaatgagatccggtcatttgcaataacgtggatggaactggaagtcattacgttaaatgaaataaaacaggcacagaaagacatacactgcgtgttctcacttatttgtgggatgtaaaaatcaaaagaaactcatggaaataaagagtagaaggattgttaccaaaggctagaaagggtagtggggtgtgtgtaggagggaggttaatgggtccaaaaattagaaataataatttctagtatttgatagcacaacaggatgattacaatcaaaataattgtacattttaaaataactaagacagtatcattggattgtttataacacaaaggataaatgcttgaggggatggataccccattctccatgatgtgattattgcccatcacatgcctgcataaaaacatctcaggtattccatatatatacatatatatatatatatatagagagagagagagagagagagtacccactaaacatatatctgtagtacccactatatatatattatgtacccacaaatattaaaaattaaaaataatccattttttctgatctacaaattcaacatacaaagagaaaaaaataatgcttttctatacaacattttcctctatcatgaaatacatattaagtaaaaccccttatacttgagttatttccaaaatttataaaaagttgctttaagtgattaaagtcataaaataatggctagtgtgaaaattactgacagttcatatcagctgatgtaaatgaatctcagcaaaatgcttagtataaaagttcattttatgtacaaacctgtgaatatgctaaaagacattccattgtacaccttaaatgggtgaattgtagggtatgtgaattatatctcaataaagctgagctttttttaattaaaaaaaggcataaaaacaaaccaaaaaaaagctcaatgtaatgcctgttggttaagatgaactattccacttgttcacctaacggctaatgcagagttcattcacacaattcattcaggcagttttcttaaagcccaaatatgatacaatgcttttacttggtatttttgttgtttggttggcttattttcccatttgtgtttttgtttcatgaacaaagcgagtacagactataccaaccccaggagccaaaagttgccaataagttggtaggtagtgttgcctcaaggaatgcaatcaattcatcatttattcactttctccctcattcaataatatttattgattatcagtttgttcaagacaccagggatgcagtggtgaaaaatactgacaaagtcaggtttactctctcttggtatcatgctgctaccaattcattggtaactttagggggcagtgaaatgggtgaattaccactttctaaccctgagcctgtggtatatggaataaagagtaaatgtataaaataaatatttaaagatttgtctaagagggtccataaactatttcctctaggtgtttttactgttgaaaaatcccatcaattagatggaaagtcataatcacacttcctctattattactagtgtagatagatatagactataacagctagagcccaacatttccaatattttaactaagacagaaaaggttgccagtgggtccaggaaagggagaagttgggaatgctgagaaagtcccaccaaaggaaactatatcccatgctgagctctctatattcacctaaaaagtgatcatgtcagacagagtttgaaattatgaactcttattatataaatggggaaatactgtgacctaaaacagaccaaaataatttcattacatggacaaccatggcattatttctatagaaccagagactatatcatttcattattaatttaataacaacatagaagtgggagataacatgatgacttcaaaatgtgtcttacttgttacaaaagctgaatggtaatatccacaagagatccaggagacaggtttcccaatggtcacttgctgagggacacagacattacttacattttttaaaccaatttgcccttcggaattgtcaccccacataaaaagtcttccatcctctataaagaaaaataaaagggggagaaaaggttttaaaaggtagccaggctctgaagctattatacttccaaaagaccatttattttattagttcataaaaattatgtatcttaacaataaagtactactaagacatttacaccagctagctacttaagagttcaatttatattgtgaaatgcttctataatgataaagaacacagaacagcctgattgtaaatcacttaagtcctgaccatatttttatctcgatagcaaagacagaatgccctttcctacaatcaccctttcccattctgatgtttctaaacagaaatgttctcctccttccaagcagcctacctgcaactgaactgaaagacagcacaggtcacattagacacctgcaggtcaaaaaagcctggaagaccttgctcttgggagcactgtggaaatgatgttttgaaaaaagaacagaagaaacgtatttcactacattttttttccttataatttaaacctgaaaacacagaatctagcctcagagaatgaagatacaatagcatgtacagcatctcaaaaataggtaacatataatttctgataagggttttgatgtcagaaaaagttaatctaggaaaaatattttagaaaggaattattaagacttatttatttatatattttaaataatttacatttttgaagtattttaataatgcaaaacaaataaatgaaaataagaactgaaagaaggatgtcaaaatgctaacttaagggctgacaaaatctaaaggactgagcctcagagacaactctgactttcctgatagagtaacaccggatgttacacagtctcctgcttgaaacaaagcagctaaccagcagcttcagtaagatcaagctgatcttggctccaaattttaaagaaatgtctcatatgggcttttggtagggagggcagagaggtacaatgaccgttgcaaaccacattttaacaacatatgctgcaacagatttctgtggatgtttctgacagcaacttcagttaaaactgcaagtataactttaagagcacacaacaaaaataatatttaagaatatctaaaggagtagacagacggcatagcttagagcttatttgccaattactttttaaatgtatatttaaataagcacaaataagcataaaataagcataaataagcataaaattgcagtatgtcaagatttaaagttatattttaaatgttttctgaaagcacatagatagtcgatgaaagaaaactaaacagcaatgctcccttcggtttactgagttggcatatattgatctacaggaaaggaatgtgtcccagactgaaaaagaaacaagtctcaccagttagggcagctgaagtattagatccagcagacagctgcttaatcttatgctcggatgtaaaaaagctaattacatgaaaagtgtttctttcttcggtgtcaccaagccccaactgtccttcattatttccaccagttgcatatacattgcctccttctgcacatggaaaagaaaacgtcaatagactatagagtccccctttttatgagacaggtcagtgtatagcagcgatttcctctattaacagtgaagaaagttgaaagctatcactatcctattatttgggagacaacttcatttcatcgtcaaaataaagcaaaacaagcaaggccacatatttttgtgagattttagaaatcaatctagaatgtaactagcaactgaaatgaacagaatgcatggaacgtatttatttcttgctaatatagcactttattaattcagagtaaaaacaaggaaagtaacttccaaactagtttaaaatgcaaatctattttaaaagagatgtgtccattaattttaacttctgtaaccattaaagctaagatataatagtacaaataagtaaaacaaggcaaatccaagaagaatctaattagaaacatgataattctttgtatttattttaacttcctagctaaataggaaggcactatagcactctgtttagcaggaaagactccagagccagactgcttgggtgcaaattctggcttaccacttaccaaagctgtgggaccttgggcaagccataacctctgtgtgcctcattttcctcatctataaaatgaggataataatagtacctacttcatagagttgttatgaagattgaattagttgagatttgtaaaattcttagaacagcatttggctcatttaaagtatgtaaaaatgtttgttaattactctgttaattaaataaaaagtacatcatgcctagattataaacatttccagtaagttgtaaattaatgaagatttgtaacacataaattagttatgtcataaatatataaatgaagttaaagccttgctaaattataaggtgaaatgagggcaaaatcagcctgagttagtaaaaattttaaagttattgttatttttattttttgtttttaggaaaagacgaaacctaattggggaaacaagactagctttcaaatggaaaatacaaggtcacatgcaattggagtgcacaatttcacacacatggagcaaaccagagttggtgagatgctgaaataattcaaacaaataaatgaacacacagtcacaaaatgttccatgaaagaagttaacacttaatgggatctcaagaaataatcttaaaaggctaagagaaagagaaaagacacttcagaaagggaaaggtatggagaggtggagaggagctgaggcagtgaaaacatcctgaagacagaataagtggtggtgggggaggggcggggcaaggggcaggggcagggggaaggtggtaggaagtactgctcagtggtcaggtcctggaggtctaaatgttacagcagcatttgctgaagatactatcctttctctattgaatttccttggcatctttgccaaaaatcaagtgggcatatacatatgggtctaattgtagactctattctgtttcattaatctttgtctatctttttgccaatacctcagtcttgattacagtagctttacagcgagtcttgaaaccaggtagtgccagtcctctgttatttttcaaaattgttttggctcttctacgtcatttgcttttccatataaatttcagaagcactttgttaatttctacaaacacacacacacacacacaaaagctcatatggattttgatgggaattatgctcactcacatcaacagccttctgggtgccttccactcacccttagtaaggaagagagaagagcaagaacaggaataaccagcccttaaggtggacacacaggttaggagatgctgtcccatgatagaatccaagaaaagaagctttttcttcagccatttgacatttacgtgtatatttgcaaaggcaaacgtgtactagccattgacattttaaaaaaccctaattttactgttgccaaagtataatctctattaattttacaaagccacgttactggaatgagacctcagttctcaaagtcaggcaggaaatcatacaggttgagcactatacctgttgacaccagggtgtggttccttccacaggcagctaatttcactttttcaggttttagagctaaaaatatttaaaatgggacaattattttatagcaatgaaaatgaacagtagtccaggacaaatggtaactaagtgatagaaccgagatttaatagcgggcttgtctgattccaaagtcaatgttcttaacgagcaaaccagaggttttcagaactggttgtgtaccatcataacaagtggagctttgaatacaatatagatatcttagccccacccctatggaatctgagtcagtgggtctgaagcagcggctaggcatttatatatataattataaactccacaggtaggccgggtgtggtggctccccagcactttgggaggccaggacaggcagatggcttgagctcaggagttccagaccaacctgggcaacatggtgaaaccccttctctacaaaaaaatacaaaaattagctgggtgtggtgatgcatgcctgtagttgcagctattcggggagggggtgctgaggtgggagaatggctggagcccaggaggtcgaggctgcagtaagcagagatcacaccactgcactccagcttgggtgacagagcaagaccctgtctcaaaaaaaaaaaaacaacaacttcacaggtaattaatatgtgctgagacccactgtattctattatgctgcctcctcaccaatctgatccattacctaacctgccatcaccattatcaagctcaccttctaccacattcaatgaaaaaccgaagaccaatattgataggcatacacctatcagtcaaagttgttcattcattcatctacatattcaaaaaacatttaaagaacatctcctacgtgcttggcataggggctgcaaaaagatgactaagatagaatccctggtctcaaggatcccatagtctaaacaatcctgttagcttgtctattagataagatatttgagagtaagggtcatggtcactgtgactatcctcaggtgtttagactatgctcaataaatactttttgaacacatggaatactttaaaagttccataacaattcccataaacagcatgaatatgataagctacactgaaattttgagctgaaattaaaatttagccaggaagataaaaaatactgctcttattgcttctcaaggaatctccatcatcctttcaagtttagctgatgttcacaggttatacccaaacagaggttttgcatataacatccagaaagctttgtaagggtattatatatctaatattttctggaacactcctgatttcaaatattttgtcctgttgttcttttacactagtactaatcaatccctagtctcgatgtttcgtttacttcacctagtcactatataaagcaggataagtatgttttataaaaccagcaaccaaatagaagcataatgtccacaactgtattaaatgagaaaagctcaaaattctaacatatgtttgttctctgtatatacaataacagtaatatgtaagtagttttacaaactaacaaacaaacaaaaaaagatgggggatattcaaatgcaatactgtaaaatcattacttcctttgtggtccctggatttaaaatcaatctgatttttagaccctaacatataaaagcagttctgaatatcatataaaagataagttaaatgctaataatattcaagcaaatgtcagaaaataaagaactaaaagctttattatttatgacattaaagaactacacagtcaacataaaaatactttatacagtttgtgaaaagataaaaagatcccaaacctttgacacatgttggcttgctgatggctgactttgatcctaatcctaactgaccccagttgttactgccaaacatgtaaagtttattatttcctggtaggagggaaaaagaaataatcaattgaagcatttttcacataatgtaagatgaggtcaccacaaagcaataaaaagctatacttttaaaatgtcactgcttttctgtgttgaaataagttaccttgttcatctatgtataaccagtttctattaggtggaaaagagtttctaaaattatacggtaacaggtttttttaaaaaattatattgaaatagattcattccaagaaagttgtgtgtatagaaaatcatacttaaatatactaaggaaacttaaaatttaaaagatgctcttgatgacttattttgtgaagaattctccagcaaagtaaaaaacaacacttttgataatattttcaacatgtttaaaacacagcagcatatctataacaaaatatttagaattttctaagtattactgtccttattcaggattgtaatactaaccggtaacaacagcagaatgttcatctccacatgaaagatgtacagggacatcatttttaaaccagaatttaccgggattattttcagcaaatttacttttcccaaatgtaaacacagcacccgaatctgcaaatataagacggtctttattttataacttttactatgttgcctgttattaaaataacttttgagtaatttatccatacaaaccccttgtctcatgacagctttgcccccactctggcaatgtttaagccttccttcttccaccttaattcagtctttcttattcctcagactccattctagttttatctatgaaatctactaaattgaacatgtattactcatatactggtataaagtaagaaatatactatcacaaggaaggcagtcatctattactaatagttctgctgtcaccaagtagatgtctattccctggaatgaaatggcacaatctgtgctattcttgttctagttaacacctcatggtctggcctctgactgagagcttttctccacacacagaaacaggacagtatttcgtttcctcattaacatcatcaggctatccatggggagagtctctatcagtcaatttggattttctttggtccagtttttccaaggaacctccagtgttctcatgtaagggaaacaatgttagcccaaatggtgaactctttttatttttgttgagacagggtctcactctgtcacccagcttgaagcgcagtggcacaatcacggctaactgctgcctcgacctcctgggcccaagcaatcctcccgcctcagcctctggagtagctaggactataggcgtgtgccaccatgtccagctaaattttgtaatttttgcacagactgggttttagcatgttgttcaggctggtctcaaactcctggtctcaggctcaggtctcaaactcctgggctcctgcctcggcctccctaagtgctgggattgcaggcgtgaaccatgacacccggccaaaatggtgaactcttaatttctctgttggtaatcccaatgaatacccataaaaccggagacagcacagagagaaacaaattactccaccactatctctttcattcgaactaagggaaagcagctagaaaaaaaaccataggctttaaaggcaattaggtattcaaaggttgttgtaaggattaaatgagatgacatgtataaagaacttagcccagagcctagcatcctcaaagtgttagctcaatagctacctctgtaaactcttcctctaccataagagttggaaatgatcactggcttctctgaactacgtgatctgtagaatttatatggcaaataattgtgctacctagcaatctctctaatcaaactgttacacaaatcagcaagatttgtgtaacagtttgattagagagattggtaggtagcacaatatgtaagatgaggtcatcacaaagcaataaaaagctatactttaaaaatgtcggccgggagtggtggctcacgcctgtaatcacagcactttgggaggccgaggcaggtggatcatttgaggtcaggagttcgagaccagcctggccaacgtggtgaaaccccgtgtcgactaaaaatgcaaaaattagccgggcgtggtggtgggcgcctgtaatcccagctactcggggggctgaggcaggacaattgcatgaaccccagaggcggaggttgcagtgagccaagatagcatcattgcactcaagcctgggcgacagtgtgactgtgactccgtctcaaaaaaaaaaaaaaaaaaagtcactgcttttctgtgttgaaacacagagttcaccatttgttaccccaaatgttgtttttttccaactattttctaaggttacagagggtatgcactacccatattgcctagcacaaagtagcccttgtgtgttctacttttcacacagaaaaggtcccccttacacacatgtatattcgtaactgttgaatgttttgtttaccaattcatcataatggagagtttgtagtcaaatataactttcaacattgttaatataaaagacaggttaccaagtcgtcaacaaaggagcactttagcttttcctgatttctgagaattcagaatgtttagggatccagttataaaatgaaaagatcctctcaacacagctactcaggaagtttctaattctcatcttactcatgcactatagttagttatagagatgtctttttctctttccagaaacagtacatgggaaaggacggtttatctttccccccaaaacatcatcacaaaatgccacggtcctaggagattgggagaggagtacatggggatgttgagattttaacattcttacatcaagtcattacctgatctgagtagtattcacaaactgttgtggcacagcgtcattttgaagaaagactaaaaacccctaccatttcccaataaccatttaaacacacacatacaccaaatagtaggccaggtccagcttttggggaaatcccaaggtgggtgatcacacataaactaattcgtaccagaaaggaaaacatagcgaatataagtattaataataaatattaatacgcaagagactagccactgtggacaactttttgagaaccactgtgaggcatctcagttccaactaataattgagttgggagactaggatctagaacagactctgagtttccccagaatgaattactttaacattttaactgttttgtcttggctcccctggcttccctgataccctcatcccaagccaaggtttggtggctctgctctggccctgtaatatctactgtcaatttatatggtcattttgtttactttcctgtatgtctcactaaattgtgaactgcaggccaggaatgtcagttccggccaggagcatggaagaaaacatacatatttcagtgaaggtatgattctgctcaaacccagtgttttttcaaaatggtcgtgacctattagtgggccagaaaatcaattcagtggatcacgatcagcattttaaaagaatgcattatcaaaaaggtgtgtgtggaatctaagtggatagaacaaggactgcttcaccagacatctatttctgttacacggtatatatggagtatcgggtcacaatgtcaaaagtatttctaactatggagctcaggaaaaaaaaggctaaaaaacactcgctaaagggtccctcttctccctctttgtccaatttatttcctgtatccccttttaccccacagccctgatcactcactctttactgcattcaatacataaccgggagctcaggacctccaaagtgcacaagtctggagtccgcactttggggagtttacagaaagtgtccctccctggccgggcgcggtggctcacgactgtaatcccagcaatttgggaggccgaggtgggctgatcacctgaggtcgggagttcgagatcagcctgaccaacatggaggaaccccgtctctactaaaaatataaaattagccgggcgtggtggcgcatgcctgtaatcgcagctactcggaggctaaggcaggagaatcgcctgaacccgggatgcggaggttgcggtgagccgagattgcgccattgcactccagcctgggcaacaagagtgaaactccgtctcataaaaaaaaaaaaaaagtgtccctgccttcaagaagctcatcaagagcttatttaaaaagcatacgaaagacaggcaccctctttcccgttctcccccatcctgttcttcccgtccggtcctctgccctcagtcattcgcgggagcgcaaccagcgatcccgccccagtccggctgccaagcctggggcctgtccccctacagggccgatccggaggcggggcccggccgcccgcggaccctccctcccggccttccgccaccggcgcgggcgcaactcaccgggcatcagctcttccggctccctcatgccacgggcagtacgggcagcctgcgccggggccaggaggctgtagaggacggtttggtcggggctaaagcagctactccgcaccgacgcgggccgcgaaagcccccaagttccgcatggcgaaactccggagatcaactacaaccgcgctcccggaagtcaacaaacagccgctacgggcaacgggggcggagcttgggaatgcaaggcgggacaggcgccgttggggaggggaacggaggccgggtggctggtaaggggcaggctcaggcacagcggaggggcagtagagaccacgcgccctctggcggcctggagcagagaggcggccacgccgcgcagtgatgctgtggagtccgcgcccttgtgccgttggaggtccaggcgccgcagggaccctgcccatgagtggcaaacgtcacaaatcccatactccgtgacataagcaagcatcgacacacaattatgacactactagtaatagtgaccagctggaacattaaaggaggtaagcactctgctaaagatatccccagcatctaaaccaacatctggcctatactgaatgctcattacgtatttattggacaaatgagtactattacaaccctgtaaagtggttaatgttacctctgtttaagcatgtgggcagctagtccagctagtccagcctgtagtcaacaaaagtaaaagctgaggtgtatatggtccactactcacagaacatacacaaaggggtagcccaacatcattgctctagaatttgctcagcgatgttatatgatgcagggtttcccatgcatcaacatttggctatcatgaaataaagaagcaaaaagccatcttccagaatgagcagatttacgtacgtttggtagttgtggacatgggccctagaatcagacacaattggattcagggatccctgaattactcttgtgtgttaccaacactttctcaggaagtttgcattaacatgaagaggggacattaaactattagttacacaaataatcatttacttacaaagcaaagtggaggttactaaggaagtggttaacaagaagcgttgacctggtgtaggaggttaagaaaggcttatctgaagaaagaacattaaatctaagaactggagaaagataagccaggagggggagagagctcttggcagagagtaaattgtgtataaaggtttgtaaggagcttgactctttccaggaacaccaagaggcgaggctggttcctagcgaggtggcaaggtcttgggcctattaaggatctgagattttatcctaaagacaatgtgaaaccactgagaagttttaggcagtagaacaacaggacaggatcagttatgtgtgtccctgaaatcattctgcctggtctagatgctttgtagagaataaactggagcagtgagaagggttcagaggctattgcagaatttcagacatgtggtcaggatggcttggagtacagttcattggtgccagagaggagcaggcagatttgaaaatattttaggtcttagaatcaacaggaaatggtttctgactattgactcctagacagtgctggactaccaaatagttcttagagcaacagcaaagatagggccctaaattattttgaaaaggatttgatattcatttttagagtatcataattgttactacgggcaaatgagaatttttaaagatttactttttaatatgcagtcatttgtttttatttcaaaatacagtaaggcacattttggtgctaagcatcccagaagatattgatgcagccctactccaaggtttccaacataagcaaatagcaggaggggggcaccatttactgagatggggaacactgaggaaagagctggcgacattggagttaggtaaatggggcaagaagagcataatgagttcatccttgagcacactaagacatcaaattggaggtgctgagcaggtaattggtgagcagaagccccagaaggaggcacgtatttgaggaatgactgggtctatatagtgaaagcaggcttgagatacttgcaacactggaaagtgactgtagaattgaggcagtagaatagggtcgggaggcaggaaagctaaggccaattcatgctgacttcctagaactaaatcaaaaggaaaccccaactttccatacctaagtaacaaaagaaccagaggctactccctttgcaacccccaccccctttttctgcgtggcagacggaaaattgaaagtatctctgattagttgctttttgcaaccaatcagacatttgcatgggagtgtaactttgtaacttcactttagcctctgattggttgctttccacaaccaatcagatgtttgaatagggtgtaacctttgtaagtacacttcagcctctgattggttgcaaggccactagttcatttacatagtaaccaatgggaaatataccaatggttacttgggaatggcaccaagtaaccagtgggaaacctctagagggtaataaaatcccagaaaattctgtaaaggggctcttgagcccctgtgctagggcctgctcccaccctgtactttagttttcaataatgccatcatctccggcatctgtgagtctattgctttacatggcaaaagggactttgcagttgtgagatgctggattcaggaccttgagatggagaaattattctagattaaccaggtaagcccaattaaatcctatgaaatcttaaaagtgaagagcctttccaggctgtggtcacaaaaagatgtgaagatgcaggagtggtcagagagatacaacagcgctggctgtgaagatgaaggtaagggccatgagcggaggaatgcaagcagcctctgaaagccgggaaaggcaaggaagtggatgctccccaagagtctccagaagggaatgcaactctactgacaccttgattttagtccagtgagacccgtttcacacttcagaactacaatagtgtacgataataaatgggtattgtttaagccaccaccaagttgatggtaatttgtgacaacagcaagagaaaactagcacaccatagttgatctcatcaaatcttcacaggaaccctaaatgaagtactaacttcagtctcatttttgggaagaagaatctgaggttgagatcacataattttgcaaggtcccatatttatcaagtggtagatgcaggattgaaccgtcagttccagagccacatttgtactgcaaattcacatgagctctacagtatgaaagtgtgtggacccttgagggtcccctacaagtccatgcagcaatgcacacacatcttcaaggatgctcttgcctcctccaaagagccccctagcaatctctgcttcatcatcattcaattctgaggctgtgttgtgtttttttgggagccctctccaaatttgcaatgaggccacatgaccccttcatgcatcaaggacgttcacatgcctcatcacagcacttattatacagtgtgatgtgattttgtggctgtctttccactagactgagttctttcatttcctgcattgcaagcactacctctctttggccagaacatagcactatgtctggtacatagcttactaaaatgcaagttctatgagggcagggaggtttgtccattgttgtactccagtgccagactattacctggcccataatagctacacaataaatatctgttgaatggcagaattaatgaatagcaagttctcaaatacgcagaggctgagggtcaataaacctataaaaataataatttaagccaggaggaggtgtcatcctgaccccatgtagaggggctggccttagctaggaggagatacatttctagcataacaggatataaatgttatctatatagtattttttttttgagacagagtttccctctgttgcccaggctggagtgcaggggcatgatctcggctcactgcaacctctgcctcccgggttcaagcaattctcctgcctcagcctcctgagtagctgggattacaggcacccgccactacacccagctaattttttttttgttttttttttgttttttttttttgtttgtttttttagagatggagtttcatgatattggtcaggctggtctagaactcccgacctcaggtgatccgcccacgtcggcctcccaaagtgctgggattataggcgtgagccaccacgcctgtcctatatactattttttttgagacagggtctcactctgtcacccaggctgaagtgcagtggcgcaatctcagctcactgcaacctctgcctcccgggctcaaccagtcctcccatctcagcctcccgaatagctggaaccacaggtacacaccaccacacccagataatttttgtatttttgtagagatggggtttggccacattgcccaggctggtcttgaacttctgagctcaagcaatccgcctacctcagcctcctaaactgctgggattacaggtatgaaccactgtgcctggccatctatactattgatatatatgatccagagctatataatatatatcgcaaccccaggccacgaatttgtactggttcatggcctgttaggaacagggctgcagagcaagtgaaacttcatctgtatatacagtcactccccaccacccaagctccaccccctgtcagatcagtggcagcattagattcttgtaggagtgtgaaccctgttgtgaactgcacatgggagggatctagattgtgtgctctttgtgataatctaatgcctgatgatctgtcattgtttcccatcacccccagatgggaaccctctagttgcaggaaaacaagctcagggctcccactgattctacactatgttgtatatttgtatataacataatgtataccaacataaatttgtatatttagttatatattacaatgtaataataatagaaataaagtgcacaatgaatgtaatgtgcttgaatcatcccaaaaacatccccacccttcccctcaccccccatcccctgtcagtggaaaacttgtcttccacaaaactggtctctggtgtcaaaaaggttgtggaccactgatatatatgatgtgtatatatagctatgctgtagccctagattttatatatatatatatatatatatatatatcatataacataatactatagtctattccagaaggtggttgtgaaatattaggtaatgcatgcaaaacttatagcttggtgcctggaatagtggagcactcaacagtgttagctattaataaggcaaaggcagctcactgtattagtcagcataacccatgctatgctgcagctcaaacaacacccaaatctcagtggcttaacacaaagaagtttctttctcactaatgctacatttccagtgtgggtcagtcagttggaggatctgctctacctgctcaagcaggggcttaggctacatatggaagttcaactaccttgtagcaacatcatatacaacacatgacctctttggttgctgtagcagggcaagagagagaggaagttagaaatgaaatgtttcaggctgggcgcagtggcttatgccgtaatcccagaactttgggaggctgaggcgggtggatagaggtcaggagttcaagaccagcctgggcaacatggtgaaaccctgtctctactaaaaatacaaaaaattagccaggcgtggtggtgggtgcctgtaatcccagctgcttgggaggctgaggcaggagaatcacttgaactcgggaggcggaggttggagtgagccgagatcgcaccactgcactccagcctgggcaacaaggagaaaactctgtctcaaaaaaaaaaaaaaaaaaagatataaacggaaatgtttcaggccacaagtaacatgtttttccttctcacaacccattggctggatttagtgtcatgtgcctctgtgcactgcagagaggctgggaaatgtgggagagccagtggacattcagtgagtagtaaacagctctgccacaatccctgcagtcagatggtttaagcctgtggagccacctccctcatgttggagaaggcaggtataattttatatctctcaacagtcacgcatgctttcggtgtcgccttcatacacagccaaatattcctctgctccttaggaaatcatgttgatacacagaagccatgacacgtctgacaacgtgcacaagtcttagcagttgcctctattaattcaagttgttattcatttctggagcattgtatgtcaactagaaatagaggcatgtatgaacaaggaagacgtttgatggattatgcttcctagctgtatttgtttctttctcgacagcattcaacaaaacgtccaaggcttgcaattttaagtagcattacaatgcagctgccatcgctgtttgtttctctatatggaatcagataaacaggtgtgtctctacaaactccgctgggaaatcccataagcatatacatttacaaaacagattctaattacttctttgatttctaaacttttttagtgcagttctaggatatatgatttgaggactcataggtccaaagccagggagttttattcatgaacaagaaacagaaggcaggtacagtctactgcacattttattacgccagagaagaaattttgcactttccttcctcagggtagagtttcaaaagaagaattttgaggtgtctgtgacagcagttgtatgaataggtaatgtcctgaatgactactttgaaggatcatgtactatgatgataatggcttaggttaatatctcttattactgctagatattgttctaagcactctatgtattaactctttaaattcccgtattacagaagagaaaaagttaagttgcccatggtctctcagcgaaaacatggtgggggctgggatttgaacacaggaagcctggttccagaatctatgttcctagtaactacactctactgcttcttgaaagagcacagaacagcagtcttcagactttttagcttacacatcttcatttataatcaaccaaaagccagaagacatgagagctcattaatgtagcccatgcaagtcagctttcctgggtagatatctagcactagaggcgatcagctggtgcacagactcaagtcagaagattgaggaatgaggctgagaaaaaaagccagagatcaaggaagattactcagcagaagcaatacatgtgtatttatatatttgtatgcatgtgctactgtactactatattgtgtatattgtaaagcatacacaaaaaacaaaagattttaaagggtgagataaacataattaaaagttatattatttgttttgttccaccaagatggattgtcttgagcattccctagggcaggggtccccaacccctggggctgcagacctctaccggtctggtccatggtctcttagaaaccgggccacacggcaggaggtgagcagcggtagagcattaccgcctgagcttcacctcctgtcagatgaatgaaggcattagactctcataggagcacaaaccccatagtgaactgtgcatgtgagggatctgggttgcccgttcgttatgagactctaactaatgcttgatgatctgaggtggaacagcttcatcccaaaaccagccccatcctcccaacattccccaccctctggtccatggaaaaattgtattccaggaaactgatccctggtgccaaaaaggctgggggccactgccctaggggacatgcaccccagtttagagaataggcttgggatagcacagttttgactacaggctttatcacttactactttagtaatctgggcaagctgcttactctctgtctctgattcttcttctggtaaatcaggataacacctcctaatttgcaggattgttgtgtggtttaaatgatatgatgtgtacaaaacctgcagtgtctggttttcagcaagctctttacttattacttattttctcccagagttttaattcctattatttgtgtttcatgggctgtgtttttaaaatttcattgcttcctacccactcctgtaattaagctgcaggcagccctgcagttagacatggtgcatctagatggagccagattaatagctttttcatgctgcattattgcaaatatggcacagctgtgtctctgacagaaaaaattgaggaggagacatctggaaaaacctatgtgcattttactttgtgcaaagcactataggaattgggagggaggaagaaagggaggactaactgactgtcagacacttaaaaatgaatggcccaactgttcagcaattgtatatctgtgaacagaagctcccttttacatcagctgttagtcactgccctttgtgattgggaatcaggcttgaaaattctgagtgtattttgagccatttttatctatgcctttctgtgggcgactttttcctaacagggtcccttgaaaaaattcagtctcatttactaccattcactaaaaatttcacctttgatcccaactctgagttttttttttccttctttaacccccttttagagtgttaagtctgttgggtttctttggcacaaagttaaccagaaaagaaatgtccttgaaggcatatcaaccaggtttccaactaacagattacaccctcttgttaggataatttgagaaggatttatttataaaagaactaattttgaggggttggaaggagattggggcaaccatgaggcattgtgcagaagatccagggataacagcattagacctgttactattctttggcccaaagagagaaaggaatggagagtttattagaacttggaaggaaagagagttgtgtagagcagtatatcttgagagaaacagtgaatttctattaaggagcaagccaacccaagatgtccttacagaaaggggagaataaaaattctgactttactctactccctccctccattctcctgctgtgatttcattggccaaacccaaccagaagctagaagatatgagagctcattgatgtagccatgcaaatgagctttcaaatcagctttcatacataggtatctagtatttgaggctgtcagctggtgcacacaatcagtgggaaatgaagctcaaaaataaaaaaaataaaaataaaaaaaagagagagatcaagaaaagctacccagcaggagcaatctggctaggacaccactgctggatgcaggtaccgctttcaccatacttttaattttattgtccctttatttttcagtcatagtctccagagcaaagtcctaggtgggagtattcaattggccgaggctagttcacctgcccgcaccctgtttgccaaggggtgggaagaaagaatattgcttgcctttgccctccctggtaggaattgcacttctgctttttttcaagactcacacaattagagatttgtagatattaagaaacagctcagaaacaaggtagttctctctcctctaaaaaaagatcagtctccactaacagtgacctcctaaatctttattaatctgcaacaggaaactagcagacaagagtacagagatctgtgtttttatttccagttctctatcttttctccctcatttccttccttcctccatttcctgatcgttggaaagcccctttatctctccagatctttgtatgagagagcagcattaagatcaccaaatctagttgtaagttcaaatgctgggccgtcaaaaaaacacatacaggcccaccaaatagcatgccttagtcaacattttcctggtagaaacctcttggtttgttgatacctaaccttcattgaagatgcatgtctctcaatacaatgttgtgttttccttggctgctctttatgtaggaaacatttatattgtatttatatccttaaaatgcaatgtaacattttttaacagagtaaaagatgagacacacataagagactcctctgcactgtgtgccttctgatatgcattcacaagggacaacaaatattctcactctctgaaaagtccatctacatttttctccaaatttccttgcctccagtctctaatcttgttccttccatgtccctaaatatctggccaaaccattaacccctgatcatgatttggtataggtctatgcctctggtcttctctccctccacgtaaaatgcagtgagaggcactgcttgaaggtttgctcactgggagcgtttgccgtattcaccgcttggattcggtatagatgctcgacctacagtgaatcttgaattgttggatccagaccaatctataattacatttctcaaccttcatcaatcatccttacactctattcccatacacaattccctgaattttttccattataaactagaaatctggaagctctttggccttgtctggcttttgactttgttattgctaccgtcctccaagggccatgctgaaatctgacaatcttgggaaatgatagagaagacaggaggatgatgagaactggctttctcttgcaagtaactccctcaggttaaaaaaaaaagcatcttcaatcaagggaagaacagtttcatcagacaaagcaagagagatttctgaagctggcaaaagagatttaatgagaattaagggtttggcattcatggggtcttctaaatcctctcatgtatttccatgtcaattttccagctttcaatctaactcagataatgccacaatatccacctaagaaacctgtcagggctgtgagtactactgacattgtaattgatcagcatgcaggatcaaaccaaagtctgaatttatctttgaccatctcagatctgctgaggcaaatgacttttttcaccattaagctatttgttataagaaatagccacctcatcagctgtcattgaactcctcatgccctttatactattcttgaatcatactctcaatgggcattccaggtgaccataggcaactgtttaagttgttttgcagctgtgtttctaaagttcagtttactgtcagtcaaccagtcctgatttttaattttccctgagagtcagttgcctgtggcttgttttgtgacaccggtttctgaatccgtcagagttcttgagaaataaaaaggatttagtgggatcactttaagttgaccaaattgtttcttctaaataaataatacatccacactttgcccccttcctttttttgtttgttttttgcaaacaagatcaaccatgtttatttttaaacaagagaaattataaaccaggatattctttgaaaaattaggtagaaggcaaaaaaccatcagggaatgcatagaatttacggaaagtctagagagaaatacttgggcaaaggtgagaaactagggaagagaggcagcaggaaattgggttaggatgttgctgctgactttgctgaagtccacaaccactgctggacctaaacaccatggcaaggccttgctagccacgggacacagtcagcattattggttggtaaatctcatctcactgcctcttttactttagtccttcaagatccaaagccccaggtggggagcattccagactggatcatgtgcccatgacctggcttagcagcgggtggagaaagggagtaatactttacactaagactcacacaaggggaactagttggggggtgggttcggatgccaggcaatgaaaacttattttgtctgaatcagtagtagaaagtgctttcattaggagtccagaagttgttttctatttctcacttcaacacttgctttctttctgtttctcccacctttacctaatcttaaggaaatcactgtacctttctggtcctctggaggagagagttaaactaagatattcagggcccatctgtatctaatccatctatgtctaatgctctgtcatcttagacctctcacaaatctagtaaggaaggtactatgcttacatgaggagtttaataaatgcatacatagtccaagatcgttccctttatctaagtggtagctttttttaaatgcttattttaggttcagaggtacatgttcaggtttgttatatgggtaaactcctgtcacaggggttcgttgtacaaattatttcaccacctaggtactaagcctagtacccaatagtttttttttttttttttgctcctctccctcctcctactaatgggtagttttaaatgatcattttgacccagtttcttattgaatatgaaacttttacatatgttagattctacatatttatggaattcccctataatagttgatattaaagcatttttaccttacttaccctttaacgttttatgtttattttaatggacccctcagtaaccactccaccccagtccacaaaagttaaaatgcatataaaaatcaaggtgaaccttagggagaatggtgataaaggaagttgatattctaggagaccttagggtcttatcaaggttgatgcatcagttttactttacatttcttatctatctaattatttcaccagtttgattaaatgaagctaaaattggtattgatgaaaagagaaagcacaatcaaaaaagcagataagcaaataattgaacgcaaataacttttaattatactcacttaataaagttaaggaatagtgtcaggtgccaacatcactttgtcaaatcaaagggcagtgttgggatgaaaaagaagaaaatagtacagaatgtgttgaaaattgtggtaaatttcaaaattgtgaaacactattgtatgaatttggttgaaaataaccctgaatcctaggtcgagaatatgttcagaccctccaatgaaaaccccactttttgcatccctccacacatcttattacttgtagaattctactaaagtccccaagcttccccagacccagagaaataagtgggtttccaggaatggcagttacatctggcaggtttaaaatgcttttccacttgaaattataatgggaatattagcaaatagctttaactttaagttgatcaaatagtttcttctaaactaaagaatacagtcacagtttgctcccttcattgtttttttgtttttttttttttgtttttttttttttttgcaaacaagatcaagcatgtttctttttaaacaagagaaattataaaccaggatattctttttaaaattaggtagaaggcaaaaatgcttatttcctaccccccatagtatttaattttttggtagaataataacatatgtaaaacattatgaaacaaataagaagaatcaaagttataatatgcagataatatggttctttaaagtaaaagtaaggcctcctttgtgccctcttaatgaacgttccattataaatctaaccactcttgtatcctcttatcaccatagattggttttgtcagtttctgattttttttttcttttttgagacagtgtcttgctctgtcacccaagctagagtacagtggcacgatctcgactcactgcatcctctgcctcccgggttcaagcaattttcctgcctcagccttctgagtagctgggattacaggcgcctgctaccatgccccactaattttttgtatttttagtagagacagggttttaccatgttggccaggcaggttttgaactcctgacctcaagtgatccgcctgcctcggcctcccaaagtgctagaactacaggtgtgaaccactgcgcccagccagtttctgaattttctgtaaatgaaaaacacacttttttatatccagttttttcactcaatgttatgtctgtgaaattgttcatattgttttgctcccttcctaacccaaaattatctggattatttattctctctgtctagtttcctattgccatgatgcacataagaaaaaatacctcgtagtaatataaactaaccaatacatacagaagatgatatgtgaacaacatatacattggataaaaagaatatgggggtggggaggtttcagtgacattattagacactgaagatgatgtgttattttcatatggattttgaaaaatgtatcactgatgtctctagagtcattctgtgttcaagtgattgggggaacctactttagaaaatgactgagttgtttccatgtcccctgttgctttgaataaacagactgtaattgtaaattttaactggcaaaaagagtagtggccatggtagcgaagggattttatgatccatttttattatgcatcttcattacaccggaaggcaataatcactcttggcatttagagtcttttgtatttttgaagtacttaacagtcatttattgttttatcttattttcatcttaaatgggataggttggttagcataacagggtcacagaaggacaataaaagattagaaacttgtaacgttagacagttgtactgagggagaacaaagttcctggctttcacattatttaggcaaaaagagaaaagaagaaagaagaaaacacatcataggtcttcagtaagaagcactgtttcctttttattttccactagtttagacgacaagagtgtgatttctttgtttgttgttttttgtctttttttattctttattttattttatttaaatttattattttcttaaatttcacttttttttttttttttttttttaatggagatggtgtctcgctctgtcgcccaggctagagagcagtggcactatctcggctcactgcaacctccgcctcccgggttcaagcaattctcctgcctcagcctctcgatgcatagctgggattacaggtgtccgccaccatgcctggctaatttttgtatttttagtagagccggggtttcaccacgttggtcaggctagtctcgaactcctgacctcgtgatccgcccgcctcaaagtgctgggattacaggcgtgagccaccatgcccagcctgaatttcacttttaatacagctctggagtggggtgggggtatgaaagaaagacggacacctcaacacttttatttgtaggaaagtgattagaataagccaagaactgagccagggatggggcctctcaccacatgtgccaatggtagtagttaacaaaagctaacatttattgaacactgagctaggtactgtgctacagtactctctattcattattacatttcatactcacaacaaagctatgagtaggagctgctagtactgcttgccagatgattcgcttacttcttaatggtaatacattgcataacaatgaaggtgacctggaaatccatgaactccttggttccctggaagaaatggtgaactccagttgaaaaattctggaggaataaatcaataatggtgaatatgtagcacctatgacctaggctccaaacactcaacaaagccccatgaaaagggcttgtttctcttgaatcttgaagacaggattcccatggtctatcttccagaccctaaataggtcccatctttacaggccacagagttgttaccagtggagcagccttgagagaagaaggctgtgtttaatcattagcttaaggtgagggcagagcccctgcttagtagatatagcccaataaagcaatcaatagcaggtcaagagcacctcccaagtagggtctgaagagaggcaccaactacaaagatggtttcaagtttcaccaaaaagtagaaatgggcagagaaggcattcaccaagcagtgacttttgaagccatccaagacatgtttcctgggctcaaggggagaatattgccatgaaaattattactgggacagtgctcctagaccaaaccctggtcagtagaaagcaatgaaaatgatctcatgggatccccatcactcaggtcctgggagtgtctggtagtcacagggagcattagggctgattgttgagacactggtgaactttgaacctctgtgatttccctgtttgctctgtgcctgatagctttcagtctgctaacaaatctcctttatgcagtttaacctctgtacttccaatggggaggaattggaatcagcctatgggagaagagatagctctaggattctgtgtgggaacttgaagagataaaagggcatccttgaaagagaacctcgtgctttgcatctcaactgcctctgacacaaggttgggtcattaaccatatttatttacccctttcttacttcataaattgtgttgtgcatttcctaatcttgtcttctgtgcagaaatttaccagatcacaaaataaaaagaaccaggtatggaaacttgagacttttgtccatatctaagctcaaaaaattctggattctgcttaaaatcaataacttccagggcaaatgattaacagaataatgatttcaatggaaatgtggtctatatgacaagagagaagcgagattatacttgaatttgatgattggcatttcacactctgttcagaattttagcctttatgaaggaccctgtctaccttcttcaaatgcctcaattgaaagggtatggcaggaaaagggatggagagggggtcagagataatcctcactgatttcacaatttcccctagggcccacctgtttgaataaatacctagtggtgatgtagcaagaaaacacccctgaatcaatatttttagacaaactaccattaccattaccatctgttaattagaaagtaactctcagatcgcttgaacccaggaggcagaggttgccatgagccgaggttgtgccactgcattccagcctgggtgacagagcgagactctgtctcaaacaaacaaacaaacaaaaaacataaaaaataaaaaataaagtaattctcagattctctgtaaatcaggagctcttttggtgatatatatatatacacacacacacacacacacacacacacacacacacacgtggagagaaaaaaaggagccagctaatgggtgatttcctttactataataattctaatttatttcttattgccagtttccacacaggtccaagccgcaaaacaataccgtctcacaacagagcagagctttacagcttataaaacattctgggaatattagaatattaacacatgaagatttttgggtccttcagcacgttagatatgacctgggacatagaggactcttaagaaaagagaaattgggcatccacatgtggaaaaaaaaactcaatctcaacctcaagccttagacaaaactcacagtggatcacagatctgaatggaaaatgtaaggctacaacactttcagaagacatagggagagaatctttgttaccctgggttatgcaaagagttcaacagcatgatccagagaaaggaaacaaatggtaaattgaacttgatcaaaatttaaaaattttgctttgtgaaaaacatagtcaggagactgaaaagacaagcaacagactgggaaaacacatttgcaagttacatatccaataaaagtgttgtatccagaatatatatgtagaacattcaaaactaaacattaagaaaataaacaattcaagtaaaaaaaaaaaaagaagaagaataggggtcaggcaagctcagtggctcacgcttgtaatcccagtgctttgggagtctaaggctggaggactgttcaagaccaggaatgtgagacaagcctgggcaacatagtgagactctatacctaccaaaaaatttagtttggtgtggtggcacacacctatactcctagctatttgggaggctgaggttggaggatcgcttgagcccaggaggtcaaggttacagtgatctatgatcacactattgtgaaaccgcctttgcaaaattatgacagacagtgaaagaaatctaacttaaccgaatccatcttgcttctaaccttcaagctgtccttgttcattgctgggcataggctgaactaattttgggagaaacttagtttatagtttatggtttaaacaaagacggtaacacccctttcccaaagtgacctccttcctgcctggggactagacttcctttgtaggactaacattagccacaagatcagatgagccagtttattgatctggtggtgccagctgatccatcaagtgcagtactgataccccaagcactgattttaggagcagtttagggagggtcagaattttgtagcctccagctgcataactcctaaaccatattttttttttttttgaggcgaagtctttttctgtcactcaggctggagtgcagtggtgagaactcagctcactgcaacctccgcctcctgggttccagtgattctcctgcctcagcctcccgagtagctgggattacaggtatgtgccacaacacctggctaatttttgtatccttagtagagacagagtttcaccatgttggccaggctggtctcgaactcctgaccttaagtgatcttcccaccttggcctcccaaagtgctgggattacaggcatgagccaccgtgcccgaccctaaaccgtaatttctactacaaaggcaatctagtccccaagcaggaaggaggtctgctttgggaaagggccattatcgtctttgtttaaaccataaactgtgaactaagtttctcccaaagttagttcagcctctgcccaggaatgaacaaagacagcttggaggttagaagcaagatggactcggttaagttagatctctttcactgtctcagtcataattttgcaaaggtggtttcaattgcattctagcatgggtgacatagtaagactctatcttcaaaagaaaaaaaaggtaggtaaaatatttaacagatattttaccaagaaagataaatggacggcaaataaggacacaaaaagatgctcagcatcattagcctttagggaaatgcaaattaaaaccacaatttgtactacataactgttggggtgacaatgaaaaatatttgcaataccaaatgctggaaaggttgtggaacaaacggacctctcatgcattactgctgagattgcaaaatggtatattaactctgcaaaaccgcgtgacagtttcttcaacagttaaacataacatataactaccagatatacagctattctactcctagatagttaccctagataaataaaacttatgttgacacaaaaacctatatgcaaatgtttgtagtagctctatttacaaactcctcaagcgggaaacaactcaattgtcctttaatgggggaatggataaataaactgtgatataacgatacaatggaatactactcaacaataaaatggaacatattagtgatacacacaacatgggtaaatctcaaagacattatgctaaggagcaagtccaaaaatactacacagtgtatggttccaattatgtcacattctggaagaggcaaaactataagggagagaggagaagatcaatataccagggattagaaaagaagaggatgtgattacaaaggaatttaaaagggagttttctggagtgatacaaccattgcgtattctgattgtggtggtggttatacaaatctacacatgtgttacaactcatagcactgtaggctaaaaaatgttaagtttattacatactgatgtaagcattttttaaataataaaacatatcaagtacattcatttaacaaaagaaaaattgtaagagagtattgatttccatttgcagataaggaaactgacttccccaaggttattcaaccaataaataggttctgaactagaatccacttctagaatattatttttttcctgttgttatataagaaacaaaccttcaaacacctaagccaaattgtgtattagttagcatgcatttgattgcaagtaatgaaaaccccaatccagagggattgttcttctatgaggacatttgctatttcacataatgaagtggcaagtggtagggagactcatgaggctggttgattttgcaactcagtgatgtcctaaatgactaagattccttccttcttccactcagccaaccacagcttccttataaggctacttcctctcattgtcacagggtggctactggtctcagacaaagatacaagcttctttgtccatatccagtggaaaatagctcaccagcaacagtcccacagaactcggaagacttaactagtgtgtactgcatgcaaatgctgcggcttcttaggatcttaaagattctaggcaaccagctataaaaattatttatgtaactagtaacactctgaaacaaatcagagcttcgcactgcagtaatcgccatctgtcttgtttgtatggatctcaaatttgcagtatttttttgataatagctatctatgcccgggctcttagacactatacctcatgtttgattagcatgttaaaatttccacagcaccataataactcattttatttagttggacaggtgaggactctgagggtaccgaatgacttagccaaattcaccaggagtgagtgactgagccagaggtcacatttgatcttcaaacatcattctcatcattctttcctttatatcacattgattccctcttcaatgcttggatttcactagggaagcacactggcaatttcaaagaaatatttcaagtttatacagatacttaaaagctcaaaatgtcagagaactaacattctttatatccccaatagcaacatttggctatttggaattttattctcagtaataggataaatgtgaaatcctagcatctcattaacttcttcgtctcccttctttcaacatccaatcaattttcatgataggcgaattctaatttctaaatcgctcttgcatccatctcctgttttctatttccacagccctaatatgtattcaggcctcatatttgtcacacaataacctctttgtctctttgcctctattttcttcacattgtacttctcacacaatggccccaggttaatggtttcaaaacccaatgcaaataatgacatatgtcttcttgtctgccccagctccaaaactttaataatcttcctttgactaccgattaaattctcaactctataatctggctttcaaggccctcagcaatctggcttcaatatttctttccaaaccttgagaaaatcctcctttctgggtgggagtagtagacagtggtatactggagccagctcacagtagcttgcaggaactttttttttctttttttttttttgagatggagtcttgctcagtcgctcaggatggagtgcagtggcgcaatctcggctcactgcaagctccgcctcctgggttcacgccattctcctgcctcagcctcccaagtagctgggactacaggcacccgccaccacacccagctaatttttttgtatttttagtagagatggggtttcaccatgttagccaggatggtctcgatctcctaagaactatttttatacctctcttcatctctgtgttcagtgatgtcacattagtagcttgaaattggctgtgatgggaatatttacaccttacaagtcagactgctacaattcagagcttttgttttgaagagctagttattaaacatttaccagcataccactatttacagaataactgggactaaacttgagagtgagggtgcaatatggtattggggaccaagttgttgacacagaaagctcaggtaccaactcaaagataggagggccagggggaaaagaagaagaagctgtgttgcaaaactgttgagaaggtagatctgggcaaaagttgagtttccatagaagcagacatcgagaaaggggtttgggttcaagtagttgatttgggaggtagtcccaggaagcactggcagggtagtgagggaaatgagacagggaagggaaggtggctaatacagggtagattgatgagcaggttattactgtgggcaattgaggttcaattccactggggaccttttggggagcatgtagaatgtgcttcatagttgccactgctatggtttgaatgtcaactgaaaagcttatgttgaaatttaagtggcattgtgatggtagtaagaggtgggactgttaagagatgtttagaacatgaaggctctgtcctcatgaatagattaatgtggttatcacaggagtgggtttgttatcaagagaataggttgttataaaagcaagttcaatcctctctgtctctcactctcaccctctcttgccctttaccttctgccatggaatggcaatgcacaaaggtcctctgcagatgccggaaccattctgttggacttcccagctccagaactgtaagccaaatcaacttttctttataaattacccagtctgtggtattctgttacagcaacacaaaatggacaaagccacccacacaaagagtgaggaatatgagaagtttatcctcaagaagacagcagtgggtatttgcattaagaagtggcaggtatgtaggggaagaccgaatgccaaggggatataaacaagacacagatactcgtagttttttgttttcatagcgtgcttggtggtggtggggcttcatttcaatggccaatgatggaatgtatttttccagttatatatcatttgtttttaccctacacactctatttgttccttcctttaggtctactcacaggttcctttttttgctacaatatcctttgtagctccctccagttttgactattttctgattcttgcaattcatcaaaaatcagtgccacctttttcaggaaccccatctaatccccaccccctgatgatagaagttaggagagggtcacgtcaagctggaggtctcctgtggcttgaagcaagggagcaggtaacaagcccctccacctggttaagatgtttggggtcagagagcagagacagaaattgtattctggagtcattccaaatggtgaatattggaaggaactcatcattcctgttttatcactctgtctctcagaacccacacagcacagaggattggcttatgatggctgcacaattgttgatggtggcagagaaaaatggatgaatgaaaggctaggtgaacaaagagaactagataggtagtgaaacaagaaagttaaaattgaattagaggaatcatggggtcaacaagagcccctggatgaattctgaggatgaacatcaaagcctgtaaagtaaaacagactccacatgtgacataatcagcagaagctgggtagttgaaatctacccctcaacaagttcattgagatgccctgccttttgagattcagtgaaattgcttttaacttcatcccacttgtgatgcagctccccttttccaatccctctgggagttattggtatcttaacttttttttagttccctctggctttgagctcctgcatctgtagcattaggagggtttgtgagttgctttggcatctcagaaatgctgcctgtactctctagcatggaactgcagacacttcttgatttctccccaagcattaccaatatgagttgtgtgtatggctagcacagttcagtgaagatatggggtcaagctatgggctttatattagcctgtggtttggcctcatctccctcaggctccatgcaaacgttcaatttcactcctgtattatgtggagcgcttttgctctctgaaacctattcaataactggccttgtttgcctcttcaaagatgctttattatgttttttaaattcactctctcccttctcacctctgtacctttgcaagcagttgcttctgcctggaatatcctttccagaatggaagatttggtagaggttgggaaatgtcagtctttcccctcactttatctcacatcattctctgtaagtagaaggaaatggtgacaatatttatttctctactagtattaattatgacatcacaaacatctcggctcctgaggtggccatagttggtctttaaataacactttttggtattccacaaacttctggaaaatatttacttgggtttgctaaagtcatataaattgaccagaagaggcagccctacccctgcccctcctctccttcctcctacccttcctaccttagagggctcccgcttcttcgaagccagacaactttgtctggacctctcctatgggcttgtattatggatatttgtttataaatcataccacctttactgaactgtgaactctgcaaagatgatgtcatcttccctctctgaaacttcagtgcagctcggtatctgatacagaattgactttgaatcacctgatttctaactgaggataaatgaataaatgtgaagttgcagatggccccttagtgatctgaataggctgctaggggaagagcatatggtatccccacttcccacttgtactgactgtcaggtgctgttagaatcaataggcaactatttcttttctttttctttctttctttcttttttttgagacagtgtctctctctgtcacccaggctggagtacagtggtgcaatctgggctcactgcaacctctgtctcccgggttcaagcgactctcatgcctcagcctcccaaatagctgggattacaggtgtgcaccaccacgtctagctaatttttgtatttttagtggagacggggattcaccatgttggccaggctggtctcgaactcctgggctcaagtgatccgcccgcctcagcctcccaaagtgctgggattacaggcgtgagccaccgtgcccggccagcaattatttctttattgaagacttatgtgcaaggcacaaagggagctccaggactgagatatttttactataccttctctatcatcttgcacccccaaaatagcttccagggcacttctttctatttgtttttgtggaaagactggcaattagaggtagaaaagtgaaataaatggaaatagtactactcaggactgtcacatctacatctgtgtttttgcagtgccaatttgcattttctgagtgagttacttctactcaccttcacagcagccggtaccgcagtgccttgcatatattatatcctcaatgagtacttgtcaattgattttgtacatgcgtgtgacagtataaatatattatgaaaaatgaggaggccaggcaataaaagagtcaggatttcttccaaaaaaaatacacagcggtggagcttggcataaagttcaaatgctcctacaccctgccctgcagtatctctaaccaggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtaagtgatggtcagagacttgggtttgatttaggaatcatggtgatgcataaaactatattctgcagtaaggcctctttctgcagaatgtagtgccacgctctgctttactcttatttgagacagctgcctctaattccagcaaagctttcatttctcagtccttctgtaatcagatttcaccgtgtgctgtaggggaagccacccatggcaggtataacagactaaacgttcttgacatctttcgtttgtgtacattctaaacgagcaagtggctgaaggaaattaggggaagtaatttacacagggccttcagcttatatttgggcttgctataaaacaatatatcactctaagatgttgagactaatcagttcttttgaaaaaacagactccaagtagcaactaataaatactgacaaagctgctgcaaagacgccttatatgtgatggggataacgacatttttaaataaaatacaagtttgaaaaccatccctgaaattcttgctggcatgtgcaaagcaggctgtctccaatgaattcattataaaagtttacatcctgcttacaaccattgtgcatgtggttgaagatggcatggagtgtgtctgtggggaagggaaaggggaaggggaagggaacaggggagatgagttagctgggtaaacaaggccatcaggtggagacatcactaccagaaagcttctagaacagtttcatgttaataatgagacagaatttcttcagagcctctttataacctaaagcaaccttcccgacttccttaaggaagaagcttttggtctgaagttttcttttattattagtaagtggacctgtgatagtggccctgggcatcccttctctggagcagctgacagttctaggttctctggactccaccattagcactacttctttagtgaatataaggctctcagaagtcagaatgataccgtaaataatattgtaaattaagcccataatattagacctagttgagacctcagagccatgaaataatgccttctcttattttattttgggaggaaatgtgatttttatttcttaaacagctcaaatattcaattgaaattgtttcacttctcttatttcaagtataaggtaaaaaaagcccagaatgactgtggggtttaccaattagtgccagagttagatcagataacaacctggagaaaagtttaaagaactaggttcaaggcctagcaccacccttgctggctatatgaccttgaacaagtcactaaacttttctgcaatgttgtttcacctataaaatggaaaaaaggataatacctgttctgcctacattacagggtggttcaatcattccttcaacaaatattaattgaacatctactttgtgccatgccctatcaaggagttggagatacggtggtaaataacgtaaaaatatacttcactccagctacatgaattcatagtctagtgataatcagtgagataatgtatatgaaacctaaaaagtgacagaccaatgttcattatttattttagtattccattacactgagttacatcagataaaaatgtgatgaaattttattctatagcttttaacaaggaatcatcactgagttgaaaacacccaactgaatgaataatcaaagcctggaacttaaacttatactgttctttgaaaactacaatgataattgatttttaaaataattattacggattaaattttgcaagtaaaacctcctccaaacagttgaactttttttttttgtatttactaatacactactgtctatatccagtagccagactacatttctgaaaatcctggtgagctatttctcacagtgaatgggggctggcacaaaagtatggctaaatcggcccaaatccaaactttctatttgaaagtgtgaaagcctcgagtcacccatgttgttagaaactcaatagtgtgaatctctattgaaaaatgagataatgttgaaatggtttcgacatgcattctcacgtggcataggtatttttctttcctactgtattggttagttgcactacctgtcagctagataaattcagaatttctggtctccaataagacttacaacctttgacaaagccctcaacaacagagaaaaactccctgtcaactctgcctgttctatatttttgctttgattttcagcctttcacagggattcgagttatttttttctcccacatctcttgggaaaggtggagggcccttgttatgtaacataccacgtgagtttactactccagaataataggaaatatgtggttagaatttgatggtgccacaaaataggaatcgcagttttgaagtgagcggtcatatcgccatggacatgataaaataatagcttaagtgaggctgaagccatccacacagcccctggatcaatcacttttagtcagttaaatttttttttaacaagatcgataggatcagaaaccaagactgctgaaaacacccaattcacaggctttccatgtcataaacaaggctctaaagccttgctgtgtttggataatagagaatatcctatgatttgttgcctattagggaaaccacttaaagctttttaagaaaccactaaaaaaaaaatctctttctttatcagaaaagaccaatttgtaagtgcagttcaatttcatctcacaaatagaaatttcttcagagaatattgagctaagctactcaattctgtggaggttatggattggagccagaggtgactagttttcaggtgtttcattccagacctctgtaagggctcacataactcattatgctcccttcgtctctcacacatgcccatccatacacacgtggacatccagacaacgtgattataagacgttcatgttcttgcatagaggagagaaaccagtgcactttgattattcacaatgtcgaaacttaaaatgaatgccttttaaaaacatcacttcagctgggtgcagtggctcatgcttgtaatccctgcactttgggaggccgaggtgggtggatcacctgaggtcaggagttccagaccagtttggccagcatggcaaaaccctgtccctgttaaaaatacaaaaaaagaaaaagaattagctgggcctggtggcatgcacctgtagtcccagctactcaggaggctgaggcagaagaattgcttgaacctgggaggcggaggttgcagtgagccgagatcgcgccaatgcactccagccacctgggtgacagagcgagactctgtctcaaaaaaaaaaaaaaaaaaaaaaaaatcacttcacttcagaaaaccatacaagagatgggaccaaaagttgaatggggtcatgatgttttccttggccaacagtggaatttgtttcctagtttatttttagtaattgagtaacgtaacttagataaaataagccactgatttttgagtttcaggtttccagatctttaatagtaggtctgcagaaagctagccttcatctgaattcttcaattttcagatgagaagtttcacaattttagaatattaatgatctaaggtatcttagaaactactagtcactcagtgctcaataataatgttgtagaaaaaactgagttcttttcacatgaccaggaaagtttaggctcacagacactttgaagggtgagggggagcggaatttattgagtgaaaaggaaaaaaactcagcaaagccagaggggttcctgttaacaggcccccatctcacagactgaatgccaggttaccacacaggaacaggagaggcctagctcctccccactccaaaaggtgcagtgcgaacttccccaaggccccaccctgtcctcccagtgtgcaggtgggcattattcagaaagaatcagtcaggggagtgtggggaaagggcgggcctcatccgggacaggcagtcctgttcatcagcctacaggctgttttaggcttgaacgtggggtttcgctgggggtcgcgggtttgggggcccttggctgccccttgtctctatcaataatttatatcacatatgggtatgtggcaacagtgaggagggtttcaagtaaacttttattaatacattattattgttattgttaataagcataaatttggaaaacatttgtgagtttttttcacatcagtgggatcactgcaaagtttttttttgtgaaaatacagctcctttcttttgcatgcattctaatatgcctttttgagaaggaaagaaagggatagaattaaagttaggccactgaaaattcatgtggctccagtttacaaacttcatgagtgtgggggaagacatagacaaagagaatcgctaatttcgttcactttattaaattttcaggtgaagaattgaggctcgagatggcaaataaccttcccaaggccattgtttattcttaaatctgggctgaactaggactacaattcaaatatttaaaggcactgctcttctcatttcattgcttgtattactttgatcccttccaattgatcaagctggccaatctacctttgcctaatatccttttttaggtacagccagaatatctcagtaaagaaaaaaaacatacacaagaaaatatgccttagctcttgcattaatgcaaggttaaagaaacataaaaatctcagccataaggcccattggccccctcttatgtctccagaagttaaagtctttatctcaaattgtccatggggatcagagtatcatttaacactgaattttttcctactctggcaaaatcagtttctgactgaccacattttactcaaatcaagcactttctcttccaataaaatacaattataccaggaatacatccaagtctctcccaccccccagtttaccagagttggaaaatgcagacactagcaatgaaaggcttcattctgcaagtagcaaatactcttccattttgtagctaggaagatatttgggtaaagttaatacaaggatctcttattaccttggcttagcttcttagcattcagtgatttggggttaagaaatctctgtaattattttttcaaggaataaaatgaatataaggaactagacttgcctttttcaagggctctggctctgaccagactgcagtgacagttttgatggagtatttgtacgtgcttctcattgtttcccacaacattgtatcctccctcttatgtgcagcctgaataataataatgtggtttgtgtctggtgtaccaaggagatttcttgtttactctgatttacttcttgtacactttggtacaagaaaagcaagcattttacaggagactcgaataatgcatttggccctggttctggtgcttgtgaaccagagcaggctgcctcctattgaagaatgaggtctctagggggaacttaatagccattgatgccagcagtcttacctggctaattcaagcgtggctttatcacccaaaagcaagaaaatgcttgctacagaccagaaaaaaaaaaaggaggcctgtgtcagaactgttttaatgtggtacaattgtggaactcttctaatttttatgtagcttaggaaagaggtgtggcaactccattttggagccaaggggaggtctgtgaggagacagtaaacaggataggaatttaaactgggaccattgtatttgctttccttccagtgataaatttccctggttagttctcgatatctatgaaaaacagctctttttcccaagctaacatttcctgccccacctcctggatggaattgagaaaggtggtgactactctaatgatttttcagtggtataaacagcataaccccccctcactagctgtggtggaatttttttttttttttttttgagatgaagtcttgctctgtcacccaggctggagtgcaacggcgcgatctcagctcaccacaacctctgcttccagagttcaagtgattctcctgcctcagcctcccgagtagctgggattacagacgtctgccaccatgcccagctaatttttgcatttttagtagagatgaggtttcaccatgttggtcaggctggtctcaaactcctgacctcaggtgatccagctgcctcagcctcccaaaatgctgggattacaagcatgagccaccgcacccggccagctgtggtgcaattttaaaagaaattctagttaatcactcaagccctcagatgctggtatgaccagatatatagcatctacctctctaccgcttttgtccccaagaaccctgacaacttattctgtccaaaaggagtttgtggcaagaaagaaccaaagtatcagtgtagtccactattactgtacttccatttcagccttcatggtggtatgagcaaacattggccctataaggtatacttgccagttttccaggttttggcccttgactcatagtgctgtgcttaggatccaagattagtccactcttgtttcacatacatatgtccagtcattgttcccagtagtgcaaatactataccagagtggtggggttctaggggatttcagctttagcaacacactaggccacagtcaattatcctccatgattttcaggccttgtgttcagcctgggccataccctatatttgctcttccctcaacataaattttgtcttttttttttttttctgagatggagtttccctcttgttgcccaggctggagtgcaatggcaccatcttggctcactgcaacctctgcctcccaggttcaagtgattctcctgcctcagcctcccgaatagctgggattacaggccctcaccaccatgcccagctaattttttgtatttttagtagagacggggtttcatcatattggtcaggctggtctcgaactcctgacgtcaggtgatctgcccgcctcagcctcccaaagtgctgggattacaggcatgagccaccgcacccggctgaagtgatgttttttaaaaggcattcattttaagttttgacattgtgaataatcaaagtgcactgttttctctcctccgtgcctggcctatgtcttttcttatcatcagaacttggtcaggatgttgaaaatccatcatgacaaatctttcaatattcatcccagaaatctgctgggaattaattctttctttcttttttttttttttgtttttgaggcagagtttcgctcttgtcacccaggctagagtgcaatggtgcgatctcagcttactgcaacctctgcctcccgggtttcagcgattctcctgccccagcctcccaaggagtagctgggattacaggtgcctgccaccacgcccggctaatttttatatttttagtagagacggggtttcaccatgttggccaggctggtctagaactcctgacctcaagtgatccgcccgcctcgtcctcccaaagtgctgggattacaggtgtgagccactatgccgtgcctgaattctttcttatacaaattgatttacttttgccctaatgacctactatcatttattcatttacttaagaaatatttattgaatgactactacattccaagcactgtactaagcaccgggtatatattagtgaataaaataggaaaggtccctgctatttgtggatcatatgtaatccagtgagaagagtaaaagtagcaataaataaacacataaatatatattaaaattgtgataattattacaaacaaaatgaaggtaaagtgaagactacttagacagtagagtcaggaaaggaatctcttaggaagtgatatttaagcttacagcctgagaatgagaaggagccagctttgagagttgaggggagagtgttctggacaaagggaatggtatatccgagtcctgtgatgggaaagcttttggagtacaggcagcccctcctttgcgatatcccaatgtgcacaaatttcaattaccacagtttagttaataacactaggccactacgaacacagttcaaatttcagtcaacatggcatattaattatgagtaattcataaagcaaaacttcattgctaactcttcagtctacaaatcaccatgtaaataacacatacacagtacctcatggtcagtgaccaattacatcacttctttcaaagtctgttggtgattggtcactgtgcatctgtcattcagtttgcatacagacagcaaagagtatatagctgtgctgcctccttttctcccagtgataaacccatgggcattttacaaaaatggataatgacagtgcagtacatgaaagtgcagcagagaaataaaaagtgcctttgggaggctgaggcgggtggatcacctgaggtcaggagttcaagaccagcctggtcaacatggtgaaactccatttctactaaaaaacacaaaaattagccaggcgtggtggcagacgcttgtaatcccagctactcaggaggcttaggcaggagaatcgcttgaacctgggagacagatgttgcagtgagctgagattgcgccgctgcgctccagcctgggcgacagagcgagactccgttaaaaaaaaaaaatactgatagcagtggaagttaaatttggattgaatgtaaatcgagttatggaagaaacagctgactatgtgattgttaccctgctgctgtttgagaggctgtagatatacagccagaggaacttagtgaagacaaagttattgacataactgcagaaagtggttgtgacaaaaaggatgaagatgtcccaggggaagtaacaccagcaaaacacttcacattaaaggaactctcacagatattacacagcgttcaaagtgcaaaggaaaatgttgaaagtttatccaaacttagaaagaattatgacagtttaccaaaacatagaaaagatgcttgctctatatcataggttctaagatgagaaagcaagcactgttcaaattactcttgatagagtttttacaaggaaataaagcactataattctcaatgcttctaatgttttaaattacattgtactaaaaaatacatcagttttactatttttcacttccctacacatttacaactgacaataaaagtttttaatgttctgacaattttttaaaagtcacagaacgattacaattttcccactaaatattaaggttactttacatggcttcagatttaatggctattcacagtcccacacactaccatgcaaattaaaaactgcctgtgtttaaaaaaaaaacagttttggaggacattatgctaagtgacataagccatgaaggacaaatactatatgatttcacttatataagaatcaaaaatagccaaactcatagattctaatttaaaacatcagacaatactggttgtcagaagttgggagtgggggaaaaggggagtttttctatggatctaaactttcgattattctagatgaataaattctagagatctgctgtgcaacatagtgcctatagttaacaatatggtgtcgtgcagttcaaaatttgttaggagactagatctcatgttaagtgatcttactgcaaaaccaaacagcaaacaaaaacacaaaggggcacaaggaaactctggggtgggggaaggttatctgctaacatttattggagatgtgattcaagggcagcaagagtgagggcagcattatcagctgctgccatggaaagtctagagtcagaaagggagatttttccaatcacttgtagtccaagggaaaaatattgaaataaagtttctgttctatatacatttgaaaatcaaaggccttgacaaaaaggaaagcttcaagcaggatgtttgtgtgttctttctacctttatattcaaatcttctgtcagtggagaaatagaaacagcagcatctcacaatgcaaacccacagcagaacattaaccctaaccctaactacaagcttaatttcacttccaacttagaaacttctaagtatgtaggacaaaagctgaggaagccccagaaacttgttactttctccagtctgtcttctattggggataataagaactggaagctggagcttttggagtagtaaaaggtaaggtattgttggtcctcctctttcctgtttccttttatggaaattggggagaaaaaatttagtcctttgcaaaattttcatttccacttctatttctctgagattcaacaagaacaacacaattctaagatctatgacattctcttaaataaagcctgtagccttgtgagcattcagaagtaagaggatacaacaaaatcccgcagaggctgagaataggggatgatattgaatcctttaagtatagcagtttggagactcagcttttgtgggctccaaaataaccaggagtctgagcttgaactcaagacaaaaaattgagggcctcaaaattagttcatgagtggtttttcctgtggttgatggatgtgagttcaacagctatagtgatgtttctcaaattccttgaaacagagggagtggggttttccagcaaagtattcttccccttttaaaataatattagaggaagtcttaagccaaggaatatcaatgtgttattgtaagacatgtagtcaagaaggtttatcttctgtaattttatgttgcttggatcttattccagaagaaaaatattttcaaatctgccccaactgtgaattgagaaagattaagctgccgtgccttcatttcaggccacatatgcaaatctgttttataatccccagaagaagatttcagttgaccctgaaaaatgcatgactgttagtcagtgcttactccttaacattatcagtacttagtattccaagtgttgcttaatattatcactaattaatattatcagaagaaaacacataaccaaaatttgtacgtaaatacaaattttctgtctaaatgccttgcttccaaagttatcaaattgctgactatgatggagatattgggcacagttgtgtaagcattttactaggatttcagtagaaggaagaaaatgaagggctgtctagaaactgctttagccagcaaaatgtctttgtatatctacaaacttatttttaaaatatttggttctttgccgggcgtggtggctcacgtgctgtaattccagcaggttgggaggctgaggtggttggatcacctcaggtcaggagttcaagaccagcctggccaacatggtgaaaccctgtctctaccaaaaatacaaaaattagctgggcgtggtggcacatgcctgtagtcccagctactcgggaggctgaggcaggaaaatgtcctgaaactgggaggcagaggttgcagtgagccgagatcacaccactgcactccagcctgggtgacagagtgaaactccatctgaaaaaataaataaataaataaatataataaaatatttggttcttcttagtctaaaccttttaaatttttattttcgtgtatgttttgttatgtacataatctattagtatagcagcacatataaacaaataaaacatacattatgaatccatgtttaaaagtttttactgttagaggtacgtaataaaaagttgaggaccactgctttaaagaaatttccatttggagagcccatgactcacatatttttaaaagtcaaagacaataatacatctttgaaatagcaatgttaactaaaattttgtttctacatataagctgaaaacagtaatttctatttgtagttgaatatgtcatcaatgtcttagattaaatcagtcaattggctgggtgcagtggctcacacctgtaatcccagcactttgggaggttgaggtgggcagatcacttgtgctcaggagttcgagatcagcatggccaacatgatgaaaccccgtctctactaaaaatacaaaaattagccaggtgtggtggcaggtgcctgtaatcccagctactcaggaggctgaggcacaagaattgcttcaacccaggaggtggaggctgcaatgagccgagatcacgtcactgtactccagcctgggcaacagagcaagactccatctcaaaaaaaaaaaaatcagtcaatcaaccaattagccaaccaactgacaaactcttaatccttatggaaattctcttccctactaactagacctctgaagggctcagtctcacaaaatgtctaccaaaaaatatctattcacccactgaacattaaatgaaccaatcaactctgcaagaaacatatgtagtgcaatattcacttgtctaagttactgacatcatgcagtggaaacaacaaattgagtgaatttgtgcttttcccacctataagcttatcaccattgcaaaaagacctccataaatcccaacagatgattaactcttcatcccaagtagcacaggctctcttgttaggttagaattaaagcatgatcattttgtgacagttattttacttctagtaaaattaatgtttagtacacgtggtgaaccacaatttgcctttggctgtttataatttcgaatggtagaaaataccaattattgttaaacacagataacactaggaatgatgagagaaagatgatgtccattttatagaatgattaccgcaaataacaattattgtcatcacaatataacaaaatgttaaaattgatctttttcggttttggtttctgtccaggcccagtaggtactgattcttccctcattctaaagagatgctagaccactaaaaatggaattgcaaaggaaatagacaaaattcagtttggaatcccttagttaccaccttcagcttataaaatgtgttgcagaaaccaagagaggggttggaaattagaagataatttatagagagtgtttctattgtgtatcatgtgcctcctcccccatgaaggggatactcttccttcacttcaagcccaacaaaatggctccactagggcccacagtaaactgatgtcaggatgatacctgagaaatttaaagtaggaaagacaggctagttagctgttctgatagcagaacaagatggagtctataccaggatggacctgacacttgttagagcaaagaacatggagaacttcccatgaagcaatagggaatgagataaaaaagacctagcatggtattgtttcagatcatgaccaagagacctcctggaggggtgggggaaatctcagcaaaatagaggctggatgtgttcccttggatgccagaggaaatgtaattgtctgtatcaaagactgctatgagaaattcctaatgataagcgggggttctccaaaggacctccaaaaacacatcacaagagagtcaggtgttggagacacgtgcaccaatgctagattgctagagcagaaccaggcttttgctggctcttaactcctcaccttcccttggcttcacttagaggaactgaaagtaaggaaacgaggaaatagcacattggcccctctttccccatagaggaggccagctttaatcaggcataagctggaagggaaaaggtgttaacctgcagcaaatttcttaaggtttttttaaaatcactattattattattatatttttgttacatgttattttactgagactctttgaggtagtaaaataagcagagggctttttgtatttttctgagttagtagaaaagttacagcgtccattgtattttcatccagggataaaaagaacaagctccaagaacagatttgaagggcagtagggggaaaatacgaaattattttctattgtgcattacaaatgctgcttgtacagcccaatgattttaataataatagctaaaagttatcaaatacttattatattccagacaatgtctgctttacatgtattaaataattttatgctcacaacaactctataagattattatagtaattttctaggtgtgaaatttagaagcagagagtgggtaaataaactgccctaggttgtgtgactagtaagtgacaaagccactcatgtggctatttcaagcaaataaaaattcaatctcttttcacaaattctttttttttctgtcaaacatccaaaatactggacatacaaaatataaaccaaggccatatcaaatttcaacgcattaacactttgcagagacacatgaggttatatgtgatttgctgtgctttatcaagaataagaagataaagcatttgctgtgctttatcaagaggccgaggcaggcggatcacttgagctcaggagttcgagaccagcctggtcaccatggagaaaccccgtctctagtaaaaatacaaaaattagccaggcttggtggcatgtgcttgtagtttcagctacttgggtggctgaagcaggagaatcgcttgaacctgggaggcagaggctgcagtgaactgagattgtgccacactccagcctgggccacagagtgagaacctgtctcaaaaaaaaaaaaaagaaaagaaaagaatgccttatcaacagtaaaacaatgaatcaccatagtacatgggtcttttctgaaatacatatttctcccttttaaatctctttttacaggtgtggacaaccactacaaaataaagtgcagctgaagggccgtgaccttctcactctaaaaaactttaccggagaagaaattaaatatatgctatggctatcagcagatctgaaatttaggataaaacagaaaggagaggtatgtaacattttctttttacgttccattactaccagtcccctttttttaaaggcagccttcccaaagaaagagggaaaaaaatacattaaaattcttaaacagtagctaagtaatgaaacctcacagtcaaggtaattgattatcatggagcatacaggcatacaaaaaagcataaaaatcagttattgaatgacaagtcattgcacttttttcacgtggaatgctgaaattcattattaactggatcgaacctaagaaatcatttgtctgaaaagcatttatttatttatttatttatttattgagatggagtcttgctctgttgcccaggctggagtgcattggcgtgatcttggctcactgcaacttctgcctcccaggttcaaggaattctcccgcctcagcctcccaagtagctgggattacaggtgcataccaccacacctggctaatttttgtatttttagtagagatggagttttaccatattggccaggctggtctcaaactcttgacctcaagtgatccgcccaccttggcatcccaaagtgctgggatcacaggagtgagccaccgtgcccggccaagattttatttttataccccttttcttttctctgtgtattttctatcaagtcaaaaatgaaggccaggcgcagtggctcatgcctgtaatcccagcacttagggaggccaggcaggcaaatcacctgaggtcgggagttcgagaccagcccgaccaacatgaagaaaccccgtctctactaaaaataaaaaattagccgggcatggtggcacatgcctgcaattccagctactagggaggctgaggcaggagaattgcttgaacccaggaggcggaggttgcagtgagccaagatcgtgccattgctgtccagcctgggcaataagagtgaaactccatctgcaaaaaaagaagatgatcctttttttccaagtgacaaattttaattttggatgcatatcagatatagaatcattaggataatgtcaaaaaattcacaatgatgtgacagcgttttaaaaagcatttagattagcaaagaaacaattaatggtatccaggtaggagaagagatgggatatggttcttagctataagcataattctgcattttgagcaatttatcttcgaaagacaattaatacagtagcttcatttggactgcttaattgtgaaagcatttttgtattccaagcttgttcagcctttttaaagagttggtttcaggttgagaaagtttgacacggttttgattttatctagtaggctggctctccaagctcctaagaaaaactgaggacaggagtgaccgcaactgctatgggttgatgttcctataaaacacctgaaataagagaaaaggtctccccaggcccaggcctatgttcttgacactttgtggatgagggaggttagctggcaggaatctatttgttccagaattccttctatcaggaagcccatctacagaagaggaaggaggaagcgccccaccccacattcagactctccagattgttttcaaatgacttccagaagcaaagtctttgtattcccatgaggatgcatgatgaatgtgtagctaaaacactagggcttcatcattgatctaagtgaaagttgtagtgccccatgttgtaacagagtagcattttcccagctgagaaaacacctccaaaccaaacaccttcgaggtcattgaaaactgaatggggatttcaatagagttaagtaagaaggtggttccagtatgaaatactaatatattttggaaaaaattcacatgttgaacccagaacaattaatactgctttctaattacatgtcaataagctgtgggagttactgttctcttcccccatttgtatagtacataaaaaaacattttaaattcacttttttttttttgagatggaatattgctctgttgcccaggctggagtgcagtggcaagatcttggctcactgcaacctccatctcccaggttcaagcaattctcctgcctcagcctctctagtagctgggattataggcacccaccaccactccaggctaatttttttttttttttttggtattttgagtagagatggggttttgccatgttggccaggctggtctcgaactcctgacctcaggtgatccacctgccttggcctcccaaagtgctgggattaaggcatgaaccaccacacctggcctaaattcactttttaaacaatattttaaacacttatttgggggtagttattacttattttctaataaagaatatgttttaaaacataatttatatataagatatattttaattctattcttgtccttgatttatagtatttgcctttattgcaagggaagtccttaggcatgatttttgagaaaagaagtactcgaacaagattgtctacagaaacaggtaagtccactgccaaattcacacttgtgttgaagagagggattgaaggtgaagactttggaggggtaacccagtgcggggatttgtctgcctctagcaaccacaaagaaaaaatcatttttactgggagcagcaatgcaagcctgtgaatgagatttccagttctcataaaagctgcaagcagaaaaattagcttcatctataagaattccataaggaactgagtagaagttccatataactcttcatgttcagaaaagaaatataggtgggcacacattttcaggccttgaactcacgtgggtaagaaatatgtctatttttctagcatgcaaagaacatttccttgtgtgtctcaattctgctagatggtggaaatttaatctttgcgatgttaggcaatcctcagttgttttatggtttattttgtccattttgggtctcctctccatttccccacagtcaggttaaatcatggagagtatctgaatgtcaagacatgtaggggtatggggatctggtccttggtcattagaacatcatcatcaaatatccatgctaggttctgttgggacttctatattcccattggatcttggctgtctcccacttactgcaaggtttgcttcactctcattgaaagaactcatattgagacaaccaagtataaaggggtcactggagaacctccaaccggcctgaacattgggaggaatgcacacggggctgaagcctcaggaagttcacaccatttgcgcggggaagagctggcctctcctgttccgaggtggaaactgggattcaatctgagaggcgggaagacaactagcaggactcttgctctgctgagagtccctgttttccttttttttcttttcacccgataaaccctgctcttctcacccttcaaagtgtctgtgagcctaatatttcacggttttgtgacaaggaccccattacaacaatatatctcttggtttcattctctcaacctcttagcagctctccaagacacattaggcacagaggtactacaaggctgcctctactctattgttccttcctcatgctgggtgccatggagctctataacatttactgccttctagaggtctgtcttaaaagcaagacaggttgtcctcagttctgggattctccaaactcatggagctttccagcatgcccccccatccttcagaagttgacttggggaacacatagcagagtacagtatcaaaggtccatcagtttttatttctgttgcttctcctctcttgcttctcttcttcccctttcagttcccagtattggaggccaggaaataaagcaggaggaaaaactggctctgactatccatggactcttccaaattgtgcctggaattctaggctgttaaggatattttttttcctcaagctattatctctgcagtttcaaaatggacactttgaaactcgtaagccacaaattgcctcttttctttctctctgcatttctgctctaccagacctcacttgaatcaataatatgactgcccaaatgagcaatcagacagggtcaaggaggaagtaccgcaaacaaaaacatattggttgatatttcaaatagattattctaccttacgagtgtcagagctttctagggcttagaagcaaacaactattacatgtgatttttaccttgcaatgattaataatgaagcttaccaaatagatatcaaaaagaaagttcagggggattaagcgacttgccaaattcactcaattaatacagatagcaccaagattcagatctgaagcccactattcttactaatgcacactccttccccctaaagagaaggaaggaggacgagggaaatatataaggtgctaatctttaaagccctaggaagaaaacagataagaacattttgctctttaaagctggctgctgtaagagatcatgttgatatctgacagatggtagggaaaaaatgaataaaccagtcagcaattctcaaattctgctccctttcaacactagtattccatgagttgggtagaattttattttatttcattttatcttgtgtgtatatatttttgtttttaccgttagtacttaagagaattgttcttttttgaagtcaccaaaataattgtttaatacatagaaatttctcaaatttaagtttttttaaaagggattttgctgagttcatggcatttctatgacttttccctgttcaaatgttatgtttgaaaccagaatatttctgaataaatgattggtttcaccatttataataatgtggtagttaatctattaataaaaatgagagtgacaatttaataagtttttggaggcagaccctgtgccaggtgttctacattaattatgtgtgttatctcactcaatcctcatggcaactctgtgagagcaagaccattcaggaaaacaggctgaaatggggccagcaaatggctcaaaggcacgtacctaataaatggcagacccaggattggaagctattactatatatatttttaaatacctaatttaataaactaaatctattgatttaatttaattatatggcatgtaatagtcatgttttcttctagtaaaattgtttctactggtggcattaagcattttgttaaatgatggttttctataaagaaatccttagaaacctgccccaaatcgtaaataataacaacaaataaatgaagcaaggagagtatgactgttaaaacttatagttcatggagcatttgtcattatcctcaataattgcatatggcatcctgccaaactcaacagtagaatcactgaaagcgagtagctgtcttaattgtttacagaaacagtaaaccccaatcaaaatcatgacagaacattcctattgtgagtatgtgcatcttaacagttgtcctttggtacaatttttcaacaagtaccacctgttactttggtgcttagaattaaaataggtgtaattataactgttactgccccaaatctgtgccagcccctgacatgatcctcacaggacagtccttggcaattctgttccaagcctgagtttcagagctacgttcacattcctacttatctcaggagacagaatcaaattctccacccaactctgaccatagtaattgtttatgtaacatgtttattaaagtgtaacacacaaacagaaaagtgcacaaatcattaagcgtatagatcgatgaattcttacagtgagcaaaccattgtaactaacacccagatagagaaacagaatggtagtagcacccagaagcttcccactacccttcatttccttccagtcactactcctcattcacccaagggtaactattatcctggcttctaacatcacagattcattttgcctatttttgaactttatattaatgggatcattcagcatgcgctcttttgtgtctgacttcgttcgcttaacattatgagatgtatcgatgtagctgtgtgtagttgtagatcattcatgcctcatccactctttgtgtgtgcctgcctggcaaaccagacaattctcctatgagtctaccaatgataatattcttttatagcaaatgaattgagctgatagacagatacatttattaatctcagtaaatgcagtagctgataaaagatgcaaaaggcattctaagagatggttcttttcattatttaacattggtatttcactttcaaggtgaaatagaaactggtgttttaacggctgtttcaaaatcatcgtctgtacaaagatgccaatgtaaaaattgtgatactattgtgcaattataaaagccaagcacagagaggttaataactgccttagttctaccagcaaaggtactcggatcccttatatttccaaggaatgaattctatttatactctttttaccaaagcaggcagggatctatggggaagtaaaagagcaaaataagatttacttttattttcccaaacagaaattaagaaattagcagaagaggccgggcacggtggctcatgcctgtaatcccagcactttgggagtccgaggcaggtggatcacgaggtcaggatgtcgagaccatcctggctaacacagtgaaaccccatctctactaaaaatacaaaaaattagccagacgtggtggcgggcgcctgtagtcccagccaatcgggaggctgaggcaggagaatggcgtgaacccgggaggcggagcttgcagtgagccgagaacgcgccactgcttccagcctgggctacagagcaagactccatctcaaaaaaaagaaaaaaagataaaaagaagaagaaattaacagaagaaacgctatgttcaaaaatagctgatgtgaaagcataaacaaatgaaacaggtaaaagcaggcttctctggataaagggtggagaaagagtggaagcccatctctctgtcctcttctccttggcaatggcagcttctagtggctgctcaaaacctctgatgcccctcataagcacgtattaccatccagacctggtaaaccggcaaattcttgacttgtgcttttgggctgggatctgaggcttctttttgatctgtgacaaaaattgcaaaggcaatttcttctcagaggtagtatttcctccccatttaatctttttcatgaactgctgaagtctttggctcctgcctgtacacactttctgttactcttcttcctacccctatttcataagtccaagcaccgtatcgatcttctgtatagcacaaacagggaagtagaaggacagcagattaatcctgagttgctatagcaaaatgacttatcatcaaagaaagagtgtgacttggaatagacctaccaggaggtccgaaactttgtttgaagtcttcatccatagtcctcaaccctcaatggtactcatacttgtactaggcacttagtaggtgcacaataaataattttttgacgaatgtgcggtatttatgtgtatttaggtgacgttgcatgtttataaagaaattaagtactcaagagtgattagtgattataatcaccactaaacttcattacgttgcttcatagataatagaaatttctcttctttctgttagcaaaatgagaggctgttcacaaatgagaagaatgggtcctttcttcagagtcaaattcctcctttattcattcaatgagaattcattaagcacttactatttgccaggttttattctaggtgctcgggagtgatacctcagtagacaaaacagatgaaaatccatgccttcatggggcttacattctagtgggtacacagacaataaacaacagacataataaataagtggatgatacagtatgttggaagatgataagtactctcagcaaggagaagaatgtgtctggaactgagggaaaaacaagtgcaccaatattgggactttggctttttggggaatcgttggatgatcttgaacaaaggagggacatgatctacttgcattttaaaaggatccctctgactgagaataaactgtggaatagactgtggggagcccagggtgaaagcaaggtagaagtagtgaagcctgtcaatagatagctatcaattatagaagctggggttgtggtggcagcagtggagagggtaagagtaacagatcctaggtatgttttgaagagagagacaacaagattactgatgtattgggtaagagagagatgtcaaggatgactttaagatttctgcctgagcaaatgtgaaggctggtgatggaacaaatggaaaggggaaggttgggaattcggtcttagatatattgagtttgaagtgtctattagacatataagcaaagatgttaaaaaaaagcagttgcacatgagtctggaatttgggagtgaaatctggcctagagatatttgagtgtcaccagcatatagatgatatttaaggccatgggactggatacaattataaagagagtaagtgtagattgaaggatgagaggagaaccaagggctagtcctggggcacaccaacattcagaagtcaagaaaaatagaaggaaccaacaatggtgactgagaaggagcaactaccaaggtagatgcaaaggcaaacaggtgtgatgtcctagacactgtgtgaagaaagcttatcaagtagaaaatgaagatcaactttgttgaatactgctaagtgaaggaagagggctcagaaatggccactagatggagtaacgtgaaggtcactgataactttggtgagaggagttttggtgcagcagtggtaggggacaaagccttataggtttgatggaaatgagaagagaggaactagaaaaagaaagaagaacaaagagctttgctgcaaaggggagcaaacaattaaaggaatacttgtcagggaaattaggacaaagagaaatctgtatctgtttttaaataatgtgtgaaaaatgagaacaacccattcaagatgttggtgacataagggagaaagggaggaattgctagagcaatgtctttgagtaggcaaggggagtggcttctagtgcacgagtgaaggcattacatggggcatggaaaattcatctatgcttaatagaaaggaaagcagagtatatgagtacagatgctgactagtcgggaaatggagtagagtctggaagttctcctcttattcctgtaattttttcagtgaggtagaaagcaaggtgaacagttgagaagctcacttcacctctaaagacatgcatccactgataatgaagggatggcaaaagatattccatgcaaatggaaactacaaaagagcaggagtagctatacttatatcaggtaaaatagatttcaagacaaaaactggataaaaagacaaggccattatgtaatgataaaggggccaattcagcaagagaatataacaacaataaatatatatgaacccaatgctagagcacccagatatataaagcaagtattactagagctaaaaagttaaatagaacctaatgcaataatagctgaggacttcaacgctccaccttcagcattggacaaataatccagactgaaaatcaacaaagaaacattagacttaatctgcactgtagaccaagtggacataatagatatttacagaacatttcacccaacaggtgcagagtacacattcttttccttagcacatggaacattatcaaggatacaaaacaagtaccccaaatttaaaaatacttatattaaatatattttctgaccacaatggaataaaactagaaatcaataacaagaagaattttggaaaaaatataaacgcgtggaaatttaaaaatgtgctcctgaatgaccattaagtcactgacaaaattaagaagaaaatttaaatagttcttgaaacaaatgaaaatggaagcacagcatattaaaacttgtgggatacagcaaaagcagtactaagagggacatgtacatcaataaatgcctacatcaaaaaaatagaaaaacttcaaataacctaatgatgcatcttaaagaactggaaaagcaagagcaaaccaaacccaaaatttgtagaagaaaagaaataatacagatcaaaacagaaatatacaaaacagagactaaaaaaaataaaagatcaatgaaataaaaagttggttttttgaaaagatacactttcaaaacataggaagaagccaaccattttctcaacacgttagctgctaccaccttgttccagcctatcaactctcacccagattttcgcaacagtctcctgacttgtctccctgcttttgccctgctacagatgtccaattaaaatgtaagtcaaatcatgtccctcctctgctccaagccttaaaaggcttcccattttatccagacaaaagtcaaagttgttgccttctccccagcttccttctgcagcctcacctctgcaccgtccacactaccttcttgttgtctctctctctctctttcttttttttagacgaagtctcactctctcgccctggctgcagtgcagtggtgcagcttggctcactgcaaccttcacctcccgagttcaagtgatcctcctgcctcagcctcccgagtagctgggattacaggcgcccgccaccatgccaggctaatttttgtatttttagtagagatgggtttccccatgttggccagactggtcacaaactcctgacctcaggtgatccgcccaccttggcctcccaaagtgctaggattacaggcgtgagccaccgcacccggcctcttgttgtctcttgaacccaccaatcatgaccttcacacaggaactttgcacatgctcttcccactatctcgtatgttttctatggttcacctatccatcttcctcaggtctttactcaaaagtcccacaatcattgtggcttccttgaccatactacttaaaattgcaacttgggtcctgtaaatttcctattctccttccctgctctgtatttcttatagcacttatcagtatctaacatacaatatatttaatttactcattcagtttgtactctgtctctccccatttgaaagacaaaaactggaaaaaaaagacaaggccattatgtaatgataaaggggccaattcagcaagagaatataacaacaataaatatatatgaacccaatgctagagcaaccagatatataaagcaagtattattagagctaataagtagtcaaagacttgtatcttgtttacaatgctttcttcagtgcctagaacagcaccaggcacatattttcagaatgaatgaatttcagaatcatacagtgaggccaggacttgttgtgttgtgtagttactccacagacatgagatgtgccatccacctaaaatttggtttggttgctgacagtgagaatatctcacatgcaccaggaagatatgaaaaagtttattactcacatcatgtggctttctggggatagtaggtctggtttccaagcaggtctgaaagtagccccagagagcagagaaacgatatggagttctagtgtgatttggcgatggggctgggatgaggattcccatgcgcaaggtagggcttgtgcagtttgaacctcctgctagtgccaaaggagtgagcacctgaactttcttatcagctttcccagatgtagggctgaagggtcaggcagggagaggtggacagtcaaacatcagaaatggggtcagaatgttcattacaggtcccatagcaagtaggactgtttgggcatttcatattctttgatcctacctggcacctagcacataagatttgcaagggatcttacaactctaggcaaactgtcttctttttcagatgaagaagactgagtccagtcccactatgtcattctgtctctgtagatcacactttgagctgactcaatagctggcttccctatggcaaggcctagggctgtggagacttaaaaacaatcttgcgcaattttttagactctgactctcagaacccttttctataaaattcttgtaatatctactgtacactttgtcagactaagggattcaatgaaagaatgttaataatgtgccatcatatgattatgctctgtgaagagtcattgctagggtcagaacatggtggtctctagttaaagaccatttggtctaggcatatttaagagaacacttttgagtataaaataggtagactataattatttaattttatatacagtaacagaaatgaggaccattgctttgtgtgggtttgatttttaatatttttttttctttttggagatggagtcttgctctgtcacccagggtggagtgcagtggcgcgatctcactgcaagctctgcctcccaggttcatgccatcctcctgcctcagcctcccgagtagctgggactacaggcgcccaccaccacgcctggctaattttttgtatttttagtagagatgggatttcaccatgttagccaggatggtctcgatttcctgacctcgtgatccacctgcctctgatttttactttttatagtgaaactttcaaataaacagaaaagtaaaaagattagcataatgagcataccaataccctttacatcagtctaacaattgttaatatgttgccttcttcgtctacttgttttggttgttgaactaaagtaaattaaagttacaatgatattttaccccaaaatacatcagtttgtatccccaaaaaataaggatattgtcctatatggctatgatgtcatgatcacactgaacaaaaataatgattccttaatatcatttaatatcagtccatattcaaactgtgttaaggcttcagtaggatgtttcatgagattttgagtcaaattctcctttgtggatctgaaactcctcattccccaattcaccgtgcaattaatgatttcttccctgtttatgggaaacagatgggattagcaaattgtgactgttgcttatttcccaaaagataaatcaggcacatcataataaggaggggaaaagtaatgtttgtaaaattccttggacaaatctctatcttgcaattatgtgtatttgcctttatgtattggagaaattctgagcattaaaccagtctcaaatgagacagtaaagttctgattggatgtcaccatctcccataattttccccagaatgtgtgatgaaagggctccagcctgggtgacagggaagactgtgtcaaaaaataaataaataaaaatgaaaggcttgaaaataaaagaaagtaagcattgagatagtggtttcaagtcactaagagtaaaaaaagtaaaagggccactttactgttttccttatcttccaatcaagacagcgtcatatattttattttattttttatttttttcagacagagtcttgctctgttgctcaggctggagtgcagtggcatgatctcggctcactacaacccctgcctcccagattcaagcgattctcctgcctcagcctcccgactagctgggattacaggcgcctgccaccacgtccggctaatttttgtatttttagtagagacagggttttgccatgttggccaggctggtcttgaacttctgacctcaggagatccacctgcctcagcctcccaaagtgctgggattataggtatgagccactgcacacagccagctttatatattttagagaaccaaaaccaggcatagccccaaagagggaatgatgcctcgttattgccaggtcttgaataagagggtggagaaatgggcacacatgtgaaggagagttaattacttgagcacaaaattttatctacttccctcaattcctcattttgctttgcatgggaattctgtatcagagaagttggagagctttaaagattttgacttttcagttgagatgatgccaattctttgtaattttgttttccactttagttgttttttcaaaatgatttttttcttttttttttattgtaggctttgcacttctgggaggacatccttgttttcttaccacacaagatattcatttgggtgtgaatgaaagtctcacggacacggcccggtttgtaaatattttcttctctccaaagctgatttcagaatctgatggataaatttcaaaaataaaacataattctctttaaataatggttttccctctaattgttctgttctccattttccctctttccctgatattctgaatacctctccctcatcctgtggccactttccatcggttgaaataatttttcttggcaattttttgaagaagcttctgatcataaaatttcaaacttatggaaattttgagttcatcaagtatgactcttagatttaacagttgaggaggaaatgaaggtccagggaaactgacattcagtggctcataactagttactatcagactaggtaataatattaataactactaataacacttattgagcatttattgtgtgctaggtatttttctgacttgtttaatccttataacaacccagattgtcataaagaagtgaaacaacttaattaggcacagactagctgctataacacaaaatctcaaatgtcaatatgctaacatagtgcagatgttcctgattggtaaaagggaagaacaggttattaatttatgtgggttattcagggacactggctgagagtgattctaccatcttcaacatgtgacctccaaggtcagtttgggtgttaacatccagccaggaccaaggagaatagagcatggagaaggcatacttgtttcaaagccaccttagcagggaagcagtacaaacaattccacttatatttcattaggaagtactagtagctcactcccatctagatgaagggagagacggggaaaggctcttccccactatattataatgaaactgaagcataggcctcctgactcctcatgcaatgctcataccactacatcatgtctggctaaaaaatccagagcaaatgtctttgttaaaagttttgccctcaaaagagaagactaatgattcttttcctgaaaatgatacgccatgaagttatttcttgcagataacgtctgctttttatggcaaccaccctagtataaagaattcacctcatttgacttgctgaagagatttcaaataactcttctttaaaccttttagttatgttatttcagatgggacaatgaaagtattaagaagtgtgattagcttctggattctagggacaaaaggaatcaaggaacataaattttttcttccaaataatctgcctctgacttggattatatttgtctgataattctgcttccacaaaagtgaaaatatactttattcaaaagcaaatattacaagctgatcaagggatgaagccagagacatacccaagcaaagtttcagtgaggatcctctatataggaccaggtgaaagatggtgaatgagtcatatgtaaagcactggttggaagagggttcagtgggaggaacagctgagcatccaaaaaaggagttgagcagtgcaggttggcagtcagaaagaggtcaggatccagaaatcagtgcagtgggcaggatcccaagatcaagagacaaacagccaagcatgggctgaaaattgaggatgggtataaacgtgctcttttctgggcttgctctccacacaattctcactgcaagtccttagttagaggagctctacatagatgctgagcaaaacagtctgcttacagttttttttttttgttacaagttccaaaatgattgggacattttgagtccatataattattatagttccattgctacatgaatacatgggtccatgaaatggagtccatataattcattttgaccattttgtcttatccaaaacactgaaaataatagctactccttaaagattgtctgccgtggacctcttgtgctattatctctaaatcttttttaaaatcttgcaaagtaagtattattggcctggttttatagatgaggaaagcatggctcagagaagttaatggagcttagaagctgactaagtcagggtttaaatcaagctgtctttattttctaaggccgtgttgttttgattaccccataatgctgcttctattcagcccacgagaggggcagcgaaacaagttatagaaaatattgggctgggcgtggtggctcatgcctataatcccagcactttgggaggccgaggcgggtggatcacctgagtttgggagtttgagaccagcctgaccaacatggagaaaccccgtctctactaaaaatacaaaaattagccgggcgtggtggcgcatgcctgtaatcccagctactcaggaggctgaggcaggagagttgcttaaactcgggaggcggaggttgcagtgagccgagatagcgccattgcactccagcctgggcaagaagagcaaaactccatctcaaaagaaaagaaaagacaaaaaaaaaaaaaagaaaagaaaacattgacaacattgacttgcacgtcaagaggtccccaggacaacccagaggtttgatgattcactaggagggctcacaggactgagcatatagtcatactcatagttatgatttattacaatgaaagtataccaagcacaatcaatgaagggaaaaggcagaagcaggaaaatgaaaggagtttctgctttgtggagaaaatgacagattaggcactgaacatattgcattaaagtttgaacctctgagtgcaaatgttcacaagtcattggagataaagaccttgagtgaagttgagagctgaagaaatataaatataagctcggtggtaaaaattacctccatggtctcaatgtgggagaattgcagaaggctgtgccatgagaacaggtgcaattaaggagggggaggaggaaatcctcagggcacaaagagaacaagcatagtacaatatcagaagaggctggcatgggagatgggggatgtcagaaaaaggagtagagtagctattgtagaaatctgactttcttttgtgtacgtcattactgcttaatctgccaaaatatctgacaaacaagatatgctgggactcagaaattcaataaagctaaattgaagaagacaagataaatctaccaccttccacagatgcaattgaataggagatgtaaggaagcaaatcttaatgacatctaccttgctgatatgcaccttgtaaccctcagcaatcgcttcctttgctttttgtagaagtttaacattttaaggtgcaaagggattggaggatgattaaatgacattgctggccctttcaaatcaaaagaatcatgcatgcctgacactgattgacggtgttgcttcttcattgctggtccagctgctttgggggcctggtcgaataaaaagtgcctgcacattgttgaaagaagagcctgagggagaatatagtgagtgtagcaaccaaaagaaaaaaaaagaaagaaagaaaaccgggccagtctcttgaaagctgttaaatgcaatttccatagtgccacttatttgttcaaatgatttaattgttcatttattcagaaatagttattgaatgcctcatttttcttccagacattgttttagcactgagaataaaatgctgatcaaggctgggtgcggtggctcacgtctgtaatcctagcactttgggaagccgaggggctgggggaatgggggtgggtcacctgaggtcaggaccagcctggccaacatggcgaaaccccatctctactaaaaatacaaaaattagctgggtgtggtggcgggcacctgtaatcccagctactcaggaggttgaggcaggagaatcacttgaacccgggaggtggaggtggcagtgagctgagattgtgccactgcactccagcctgggcgacagagcgggactctgtctcaaataaataaataaaataaaatgctgatcaagtcaaacaagtttcttgttagagtggaaattgcattctggagcgaggaggcttttgctaaacaaatgaacaaagcatgaatagaagagcaggttgaaataagtgctatgatgaagctaaagccgggttatttgttggtggggtggcggctgccttagattgggtggtcagggaaggcctctctgaggaggtgaaagttaagagctcaataaaatgacagagccaggtacgcaatgctgtaggaagagtgtcacagaaagaactgctgatgcataagcctaaggcagcaacaagctggatgtgttcaggaacagaagggaagccattaatgttctaaaatcttcaaacaaatacattttgaacctgatttttttttaaaaaagcaccttacagattggtcctcagtctcacccaccaaagaaaggaaagataaaatcagaacaaggaataaaaatcctaaatacacattcaaaatccaatgtattgtacagcagatctttagaacttatttatggccgggtgtgttggctcacgcctgtaatcccagcactttgagaggccgaggcagacagatcacctgaggtcaggagtttgagaccagcctggccaacatggtgaaaccccatctctactaaaaataaaataaaaaaaattccgcacacctgtagtcccagctactagggaggctgaggcaggagaattgcttgagcccaggaggcagaggttgcagtgagcccagatcctgccactgcactccagcctgggcaacagagcaaggctctgttaaaaaaaaaggccgatgcagtggctcatgcctgtaatcccagcaccttgggaggccaaggtgggcagatcgcgaggtcaggagtttgagaccagcctgaccaacatggtgaaatcccgtctctactaaaaatacaaaaattagccaggcgtggtggcgtgtgcctgtaatcccagctactcaggaggcagaggcaggagaatcgcttgaacccaggaggtggaggttgtagtgagctgaggtcacagcactgcaccccagcctgggtgacagagtgagactccatctcaaaaaaaaaaaaaaatatatatatatatatgtaacttattcattcatcttctataactgaaataattgttgaacagcaatgctcattgccccccacctccaacccctggcaaccaccattctactttctccttttatgtatttgactattttaatacttcacataggtggactcatgcaatatttgtccttctgtgactgacttatctcacttagcataatgttctccgcgttcgttcgtgatattgcatatgccgggatttccttctttgtaaggctgaatgatatttcattgtgaatatgtaccacattttctttatccattcatctgttgatgaatacttaggttgtttccacttattggctattgtgaatagtgctgcaaggaacacaataatacaaatatctctttgagtttctgatttcaattactttggctaaatacccagaagtgggctaaatcatatgataattctatgttcaatttttcaaggaacttccacactgtttttcatagtggtggcaccattttacatcaccaccaatggtgtggaagaattccaattttccacatccttgtcaacacttgttatcttttgtcattttgataatagtcatcctaacaggtgtgaagtgatattgcactgtggttttaatttgcatttccctaattattagtaatattgagcacattttcatataccttttagccactcgtatgccttttgtgcagaaatatctattcaaatcttttgcctatttttttaattttgacttttatttttttgctgttaaattgtaggcattccttatattttggacattaaccccttgtgagacacaggtgtgcaaatattttctcccattccataggttgccttttcactctgttgattgtttcttttgctatgcagaagctttttagatctcatttgaagtattattacaataaaaaagtcttacatttagagttagtaagattttaaaaattagatcataataaacaagtatcccaaagaagatctgacaattaaggagagaaaaaactgtattgttcttttcttccttgttacaataataaaacctattcactatacagaatattgtggctgaaatctcgttagcttggtctgagttgcattttgtataatctagaggtgactgaaggggagcactgaggtggagctgtccactgatattttggaggagctgatatgttggagtctctaacaccacactcaggtttgatcatttattggaaggactcacagggatcagcatacagtgatactcatggctaagatttatcacaacaaaagaaacaaagcaacatcagccaagaaaaaaggtgcatgaggtaaagtctaggggagactaggcacaagcttccacaagtcccctcccagtggtgtcacacaggatgtgcttaatttccccagcaaaccagttcccaaggcttttactggggactggtacaaaagtgccctctgcctagtgtgatcccaaattccagacacccagaaggaaagcaggtgttcagcataaaacatagtgcatatccaaacagtttgggcacagtggaccacccttctcatttctgggaatggtgggaaccctcctaaagtccaagttcctagatgctagccaagggtcagccttgtaagcagccctttgaaggacagccacctcaaggcgctatgttagcttttttctgcataatcaggctctcatctctcttctgaattttgctcaatttcttttacctagatgtactgtaactggtaagggagtgtatgttatatccatgggaagacagccttaagatttgagttgttttcttgcttcagcatggatccctggaggcctaggttcccctggatagaatcagtcctattgctcacttccctttattgaagagtctctcttaggagctccttctcaccccctaacatatcagaaaacacaaaacatacacatagatattcagttaagtttacttcagatgtgagggtattttcagattttgtcatttaccaggtgctctactggggttatgaactggatattctttttttttttttccttgttctgggcttgtccttttagatgtgacaccagaagtgaccaccttcgcgtgactcagatcactgattttttagaagatttaaatcatatggaatttagcaacagcaagtggggcattatcactccagtttcaaggctttctgtttcttctgtaatgacagcttttcatgcctaatgctcagcgtactactgaaaagtgcataatagcttcccagtcatttgtcttctaatatagtacttagtaatgcagcttcaggaaccacgtgtatgaaaggctccatataaaaccaaataatgtaacactgttctactctaatttctttccctatagatgtaatttacttatggtagtgattgctaaaatgtgttcagctaatttgtaaaaccagtagaaaagaaaatgaatgtagaccactatattagtttcctatggccaccacaacaaattaccacaaacatggtggcttagaacaacagaaatttattttcccacagttctggaggctagaagtccaaaatcagtgtgtcaacaggaccacaattccctttccagtggctttcagtcatccttggcattccttggcatcaccccaaactctgcctccatctttgcctgggcttctctgtgtatcttctcctcttcttataagaatatctgtcattgaatttaggacctaccctactccatatgacttcatcttaactaattacatctgcaaatatcctacttctgaaaaagctcacactttgagtttctaggtagacatgaattttggggaaatgccattcaacccactataaccacatatccacatgtccctatgacaccataaaaggggtttccaatcattgctattctcaaataatgaaagttatagagggatttgtggatgaggcccaatcctcaagaggagtgaaccattgtcatattaaaaggaatatttataaaaaaaaaagctggaatactgttattcaggtatttataccaattatgtccagactaaaaatgttaaaggttttacgatttttggtaaaatgttttaaaatattggtacctaatgggaaatatatatctcatgaggtagtaataaattggtacctaatgggaaatatgatacttccatgaatctttacagagaacaccaagaacccagcaggtatgaaaattctatatttttgggaaaaatgattacaaaagacagtctctcacaccatgaacaatgatatattctcttagaggcagtgtaccagagcgtcaaggacaggggcttcaaagcagagtcacagtttggttcaattcagagctctaccacatgctagccctcatggtttgggccagatgcttctgagtctcagtttcctcagttgcaaaatggagatacttatacttatcttaatgcattatatgagggtaaatgagatcgtgcttgtaaaggacacacgcacagaagaaattcaagtaatgttggttgaatcaagttatgatctaacccaatctcaagacaagcactgactcaattttggctatctctgtggttttcctaaacaggttacactgacccactgaacttccattagcatattttgaagaagttattctaaatgccattataccccattcatttttctctaaggtcttcaaacttgggatctaacatttaaatcaaaacaacctggccattatagatccttcattaataaattgaatatggcaattttattcaacatctctggcttcttccaacaccagcccatttgacaagaacccatctaggtttgctgagagtattatctatcttatttcctcatcattcttatgttgatataactaaaatcatctgggtagagatgccagagggctagaatattctgtttcccagagggagattcagagagtttatctcataatcaatttacattggggatagagattaagtctgcttaagtctccttttgggacttggctgaatttgacaaaaaataaaatcagaaacatccatttttaagtgattacagggttctcaaggatgtaatatgcacaaccaaaacatccttcctctatctcccagtcagctgttcaactggtaagagttgtcagtgaaagaaactggagtttagagggcatgcagtctgattcaaacaaggcaggatggagacaaaagagaaaatggataacaggaccctatgagaatacaacctctgtttgcctttggcttttgagacacttgcaccatgttccaatactttaggaacaactgaactccttttaagagcaccaggattgctgtatgattgtccatctcatcaacatccatgtttgctcatcaacatccatgtttgatctggcccagcacactacttgttttttattttttagtgtttgttcacccaaccacactaactctgcaccaggttttcctggggtcatgagaggctttgtttattgtctttttttgtttcattttgctttgttttgtttcagccttcagggtgttttcattaattcctaaataagtttcaaacttataccaaaagaaaaaacaccaagcaacaacagaaactaagggttggaaaggatttatttatagcaaccatccttttcatggagagagtgaccatcactctctcaaaatggtcattgagccctgcataaatcatcccatcattctcagcaaactattgcaaggacaaaaaaccaaacaccgcatgttctcattcataggtgggaattgaacaatgagaacacatggacacaggaaggggaacatcacacaccagagcctgttgtggggtgggggaaggggggagggatagtattaggagatatacctaatgttaaatgacgagttgatgggtgcagcacaccaacatggcacatgtatacatatgtaactaacctgcatgttgtgcacatgtaccctaaaacttaaactataaaaaaagtacccagtactaaggcactctttatatactcagctattttgtctgatatctatgtagtctgactgttctcatcaaaagtttatacaatctgactgagaattatctttgaaattgagttagaattggtcttgctatgattcttctcattgttctcccattttattagtatctttataaactcattggatgctaatacatttgaaggtttcaatttattataattattattcttattaattatcaaattgtcccatatttggtcaatgtcatctttgttcaagttgggtcattttgacctaactccatcagtcttcgataactctcttgctttgtggtgtgacaagatgttccaggctcatcttgtacatttctttattaagaccaagaattagccattgctctaagaagacttggggcattttcaattactttcaaagtcacacttgggagaaatttcctttcttgaatgatattttgtctgattattaaaataatattccttttgatagaatatactaaagaagattaaaaaaatagagccactgataccaccatcatccagaaataatggatgttaacattttatctctggaaccatctttccacttaaagtttcatgccgtgcctttcctttttctaaacagtaggaaaagagatgatgaatgaaactagacattttaaatatttagacaaaataggttgaacacatgttttaacttgttaatcatttttgaaaaatcctaatattggccattaaacttccagggcaagctggtatatgtgggaaactttaaatttgagtaatttggattttgcaaaagtctttttgctaccattgttggctaatgccaaagattgtctgcagagctgtaagaatgcactggaaggcaaacagtactgtatatattaatagaaatgaaaagagggtaaaatgaaaagtcattatagaaccagagagtatttttttaacttatcaacttttcatgtgtagcatgtataataaagctcttacaatgtttaaagctggggttttagattgatggagagctctataaatcccagattactattaatgtgcttgtagtccagctctagttacagggttgtcattgtttccagtgaaaaggtttgtttttattttttaaagatctttagtagcctggaagaattaaaatggtgatttctagcaattttaagcatgaagtagataccaatgtcattcacaaaataatatgaactaattgtctagttaagtgtctttaatatctttgttcccctaagtgagtccaacatgaaagcaacctaggagctgctccctctccacccccatatcattggattccaccttactcgaagctcctgtggctgaaagaggactaaagtggcattttctgccaggctttgtcacgctcccttttgcccacaggtgctttaacctccaaggggctttttgtgcctacagggatattccgcactctttgtcctttgtttacagtccaatttcataaccttatgaatttgtcaaacatttagcattttttaaacctaaaataataaacgttcctcaaagcacagctaccaagtcaacggcgtaaatagcccttgggagcttttcagaaatgcaaattctcaggcctcaacccagacctcctgaatcagaagcagctggctgtattttaccaagtcctcctggtaattctgatgcatattcaaattttcattgctttaaatattcacacactacttatacaaccaataaatcaaatgtatattaagtgaacaaaacgaatctactcaaccatttacacattgattgcaaacttaatgaaatgcttttaaacatttaacttaatcacaagcctaacatttcagatttccctgcattaaacatcttacaaaggaaaaaatacacgtaaaataccacgttgtttacatagccgattattattttgacaacaaaactgggcacaaagctattaatatcatagatttaattttgtttttttattcttaaatctccttttatttttacttttgtatggtcctggaatttaaacttctgtacattgctggattgttgggaattctacaagagactctttatactttctcagggtttatgtaatttttccagactggaaagaacaaacatatcacctcgggaagtcagggatacaggttaagtggattactggccacttaattttggttggttagtgggaacgggttgctaaattcaaggtgacttaaactcaagttgctggccactagacaataattttttatcacatagtttttgttttttgtcatggaatctatattgttttctcattgctgctttaacaaattaccacatacttagtggcttaaaacaatacaaatatattatcttacagttctggagggcagaagtctaacatgagtgtacagggctgtgttccttctggaggctccagaggagaatccaattccttgtccattccagctttcaagggctgcctgtatccttgggcttgaggccccctttttccatcttcaaacctagtgtcttcatagcttctcctctcatttctaacctcctgcctctctcttattctctagtgttatattgggcccacccagggtaatctccccatctcaagatcactaacttatgaatatgaatcttcaaaattccttttgtcaagtaaagcaatacattcattggttctgtgggttaggacatggacatctttggggaccattattttgtctaccacatgacactttttgtcaatgtatttcacatttttactgtgcatacacatatacacaatgtattttttaattaggctttacaatatataattttattgcccggtttacaactaaatatattgtgaacattttcttttcttttataacagttaaaataattgcatagtttggagaaaacataatttactaagcaatcttgttggggaaatttaggtataatttttttccaaggagatttcattcttttacaatgctgttagaaaaaaggagagtctgtcttatataactttctatagatgatggaaacttgcccttcaatttagccttttaacttgcttctctacatccacctaatcatcagtcaagtaattcattttcttttttcgtgtccatctctcccatttgcttcctcttttttaccccatctccctggcacacatgcagacagatttctattactaccccagcgctttctgatccttccctccatggcctccctttaatgaggctttctttcattttaaagagaccattttaattgattttgatcaactctactcaaaactttatcctcagtttcgcattaggattagcctttaataatctgaagatataattcaattgtttaaaagaccgtgttaataagaccttggtagagttacatgtatcaagaaacataggacttgggcacaatgtacatacggctgactttcttttgaaaaaggaaagtagtttctgggggggggcagggcagaggtaagaagtaattggtacgtgaaggaagtgaggaagtgttagggaccattatggaaatgtattctttttttgttttttgagacgaaatctcactctgtcacccaggctagagtgtagtggcatggtcttggctcactgcaatctccacctccctggttcaagtgattctcctgcctcggcctcctgagtagctgagactacagtcgcatgccaccacaaccggctaatttttgtatttttagtagagacggggtttcactatgttggccaggctggtctcgaactcctgaccttgtgatctgcctgcctcagactcccaaaactgtattcattattttaaggcaactaacaaatgatcttctttcagttaggacattggagcagcagactttactggtcatgaaatttgcatgatatctaaagttgttatttctggaaataggtaaatgtcagttcatagtaactttgtatggaaaggcatgtgccagctagcataaaagtggtacatgcagatggtagttttccagagtcctgggagccatgaggtgctcaaacatcacaaggccatcacaaccaggtagaaatgcctcaggaaagcagaggggttggccatgccagcatttacacataaaacgcttcttgggcagccagatgacatggtgcacagacccacagttctctctgcacacaacatgctcacagttccatccataggaggaagggaagacacaaaagcaccccagcgtgcaggttcccccatttggacagcaggttctgttttgttccttactgtcctgtgtccccatggatggcacaaactctgaaataaggatgaattgcaggctcctcctggggctgagtgctgtcccctctgaaagccaagtcttcctgagatagacatgcaagttatggtggcccaacccaacctggccaactaattctagttcaaatgcttttgaaatggccatgatcaaaattacactccgtcattgtcccctgaacgtttaggcaggccagaggatgagagagagcagccgtatttttatcttttaaattgattctgtttttttttttttgagatggagttttgctcttgttgcccaagctggagtgcaatgcagcctctgcctcccggattcaagtgattctcctgcctcagcctcctgagtagctgggattataggcacatgccaccacgcccggctaattttttttttttttgtatttttagtagaaatggggtttcaccatgttagccaagctggtctcgaactcctgacctcaggtgatccgcctgcctcagcttcccaaagtgctgggattacaggcatgagccactgcaccctgccatggattctgatttttaaagaaatttagaagatttaagttttgtttgtttttaatctctggcagcacatgactcattgcaatatttaataatatattaacctggcctggtttcaatatttaaaaacattcatctttcttattggcattgtgttgtaattaattagttaaatcatcaaaagttttcatttccagagaaacagaaaagtgaatcttaaaatttagacttcttagccaagtgcggtggctcacgcctgtaatcccagcactttgagagtctgagacgggtgatcacctgaggtcaggagtttgaaaccagccaggccaacatggtgaaacctcgtctttactaataacacaaaaattagccgggcgtagtggcgcatgcctctaatccaagctacttggtagactgaggccggataattgcttgaacctgggagggagaggttgcagtgagccgagatcatgccactgcactccagcctgggcgacagagcgagactccgtctgaaaaaaaaaaaatttagactactttttatggacatttaactaagttagtattttggagtaaatggttattatcgttttcctcattggaaattgcatatgcgactggtgctagccaaccgctggactccttttctagttcacttatatatgagaccacaaatgctgctgaggcctgtttattcatggtacagtttctactatttctaggactgtttggcttacaaattatgttagtaatttgtggcttatgcagataaaaacaatacatatctatactatatgaacagaaatatacttaacaaaaacccacaaatatctatctatagttatatataaacactttcctacttatgtaagtaaataaatttacatgtacataatattcactcttctttgatattactattataattttgtacattttatttacattaacttttttcttatgtacatcatgtccctttagaagcataatttatttcatttcatgatctttattactacaaatgatcacaacttgaaaaatgggagctcctttaagctgactgtttttctttcagcagtgcctctgccatttaaaaaacaaatcactcttgtttcctggcaagaacaaaatgttacagacctattctgattttattctgcccaataacgtgaaactgactatcctctaatggtttctggttctttttttaaaaatagaacaatattagagacaaaaatctggtcactagggatgtttacaagtgtcaagtggggaaagactacagctactgctgctgccttgggacttctcttgctagcgactgagcttaaagaaaatacgtcttttataagtgtgtaaaatcttgttctttccagtatagcttatcatatcgttatcccttacttttcttattgtatgagatttcagcaattactaagagtttcttcctctacattgatccactgtgtcacccagtggcacagtagcccactttcctcccacctcctctctcactccgttttctaggacaatggttctcagcctagtcttcatactggattagcttggggagctttaaaaatgttgatatgggtctcactatcatagcttctgatttaaccttccaaaaagcagaatatggcatcaggattttgtaaaagctccataggtgatactaatgtgcagccaaagtaaagaacctctgttctagaaaagtgttgcaacctgaataaagccaaccaggcatactcccatgaaattacaccacagaggttccagggataccagcttgacattataaacagaaaaattaaatgcatgcttatcttttgactgctttgcttcaggagttttggggatggggacttgctaaagagagaaaaacacacctgcctttttttcagtcttcttgaaagactcatgtgtacaggtcgttgacttctccaattgttctgctagcatttctgtctttcagtctcatcttcctcactccttcctaaccttgctctaattacttcaaggttttaaaaggccttgatttcttcatctttgaggttaagataatgtctgcatgtgacacacactaaatctagcaaaattcaacaacatactgtaaagttcgagaaaaccataacaggttggcagcctaaggtcctagctgcctaaaatgatttgagaggctataatagaagtcaaatctgcttttctggctatgagattccagaaggtcaactgcagtgttaatccagactttttttatttgtctgtacacactttagggagtgctacatgtttaaagaagtctgaagtatgacctctaggattaaacacccctctgcccccaccctctccttctctctctctctttcttggggttttagacatcataaaattaaccaattcatctgatatagggaattgatagttgattataattatataccttattgacatatctacctccacttaagttacttttccatgacagaagcttgcattcttatagtatgaaaaacagaatgtctgttttagtaagaggacaaaggcctaggacctactctatttctgtgtaatctattagtattagttcttcacttagttccgatacacacccaagtctgggaaccattgtcttagggcatcaaataagtaagggtagttgcttctctaacgagaagggccttaacagaaggtggtgaactattctttgctcagaggagtttagctgcctttttccctcaattccctccctgccaaggatattatagacagagtcttctgtttttgtgggctgccatctcagaagctttgtctagtcttgatatattgcctggttaggattttaagaaaataatagatgatgctttcaaaaatatggcagtctcaattccctctttcttaggagtctcaaactttaatatgcaaatgaatcacctggaaaccttgttaaaatgcagattctgcttcagtaaatctgggtggggcctgaaattctgaagatctaatatgctctcagatgatgctgatgttgctactctgaggggcaaggtgctagctttggttctcaactttggcagcacgttacaatatagtaagaatatttttaaaaataatgatccctaggtcccactcctagagattttgatttttctgatttaattgatagagaatatggcctgggcatcaagagtttaaaaaactctccaagttgccaggtgcggtggctcacgcctgtaatcccagcactttggggggccgaggtgggcggatcacctgaggtcaggagtttgagaccagcctggccaacatgacaaaaccctgtctctactaaaaatacaaaaattagctgggtgtggtggcgagcctgtaatcctagctacttgggaggctaaggtgagagaatcgattgtacctgggaggagggggttgcagtgagttgagatcacgccactgccctccagccagggagacagagcaagactccaactcaaaaaaaacaaacaaacattctccaagtgactttcatgtgcagcaaaatttgaaaaccccttgtcttagtccaccatcaaaagttaaccaatatcacatttttttaaaaatggctcttttattcacttctcatgctataaaatatagcgcgcttagatagttcaaagcagtggtttacaaatctctatccccactgaccctggtgtggagaagcttccatcagaagtggtagaataagaaaaataaggataagaattatatagtaaatttcataaagctcaaataattcatttcaaggattcttctttgaaattgtctttcacacctttttgatgttaaaatatcctttttaaattaaattaaggtagtaacattatacctgtttatttgcttttctcatgctcttaatttggtaaataaagagttgcaaatcttatgttgatctccacatatttttggaaatcttgctggttcatgaaatttgaaaatctgggagccatgggcatgataaatccattaaaaattagaaaaaatctgatctttaagtctagaaaaatattgttataggaatatagtttttaatctttgattctctaatccctggggccaagcagtccttgaattttgtaagcaccagagtttattgctttctgtgtcagttcaggtccactaagcagatttcaagaaggaattagacttgcaagagatttattgagggaaccaccaagaaacataaagagagaggcagcaggagtgggcaagagggccttcagacagggaggcaggtctgacccctgtgggaaagaaggatgcgtgggtagggagagagcctcagccagtagcgcagctctgagaaagtctcagccaggctggtggggagccccagagcacagactgtctatcagagaggtccctgtcacgcaggaatggcccagcgctattctccccactgtgttctgtcatcaggttggaacagcctggggagggtggccttggcaggaatgctgcagggcatccgaaggtgtagcagctagagtgtcagccaatggctctcctcacagcaagttctcttctgtagggcgatctgtgtgtgcacttccatggctgccacactgggacttgcaattccacagtgaaaatgtatcttttttctgttggatgatgtgaaagaaaattagccatatggcaggtcattaatgtttctccgtatatcttgcttttggtcttgtcccttttaaccaatggccatttattaattataactcatcattatgtctgctgggcccacaattatctccataaaaaatgtaaaatcgctggtcactggataagtcgtgggaggtagaacatctggcttatgtaatgaatacatgtttaatattaccttttaaacctgtaatgttggtaggttttcatgtagtaaaaattctatttattagtatttcttgttattatttctgatcttatattaaataaggcattattaagcataattatcttagattatctttttcttggtttgccacagtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggttggtttatttatttgtcttacaaaagagcaaaatcaaataattcctgacttgctttaagtgaaacagtttacttaaatcatggtattggtgttttattttcaaataccagcttgacaaagaattacagcttgtgtgtgcattttctggggaaaacaggacattgttaaaaacagactctaagatcgctctgcactcaaccctattcccaaacccttttagcccatatctcatcttatgttctgtcaatccctttgatttttcggtgccatatttaacacaatgaatgaatagagaacactggagcatacaaaatggacaagccatatgtgattctatagacatcaggtctgtggcttgggagtgaagactggtggagtgtgctttgaatattcaaaaaggttagttactaagtcactctggaagagggggacactttctatcattttaataaactggttatttaaagtagggttaagaatatgcagaatttatagaattggggctcaaatttagccattctagtcctcccaaattaggaacttgaataactttgaaagattcctcttgtttggtttgccacagccaatctacattatattgcccctggaaatcctaacagccatggtttctatgtctatggataactctgaggagacaagataaactggataggcccatcttcttccacatttgaataaactacacacatttaaatgtgaggttaagctcaaaataaaacactttggacatgaggatgagatccatgcagagaagatgatataattatgtcagataccaaagtggctgtctgtgggtgtggctttacatatacaccagataatttaatgcttccccctggggctttatcattactagattataaattcattgagggaaaatgagctgtcctattcatcataatgtcccctgcaggaccttgtgcaatgccttcatataggagacacttaaagtaggagctgaatgaataaatagcagcttgttaagagcatggaatctaaatcagatggatctggaattaaattctagcttagccaactagtagttctgtgatctccaaattgcttagcctttctcttttttaatctttttaaatatataaaatatatgaaacctacagacacttcaagaaaataaaacaaacattcatgtgttcacacagttttgtcaattcttaacatgatgttgatactttataattctttgctgtttttcaataaaacattaaagatagagttgaagcccaccatgtaactctgcctaatcttattttcttcctttccacaaatatgttattatcctgatgttagtatctttacacatatctatagccataaacaaccaacagtattattattattatttttgttattattattatttgagacagagtctcactctgtcacccagactggagtgcagtggcatgatctcaactcactgcaacctccgcctcccgggttcaagcgattcttgtgcctcagcctccggagtagctgggattacaagtgtgtgccacgcctggctaatttttgtgtttttagtagacatggggtttcatcatgttgaccaggctggtctcgaacttctgacctcaggtgatccgcccaccttggtctcccaaagtgctgggattacaggaatgagccactgcacctggccaactaacagtattattgagcatctttgtcaacttcgtataatgggaacatgctctgagccactatgctacactgttccaggtattctgtatttcccctttctcataccaaagaatttcagctccataaaagcagtgatttttgtctcctttgtttattgtatctccagggccaaggacagtgtctcagtgtctggatgttaatggtgctcatttgtatccaatgagtgaatacaactaagactcagatttgaaatgtatgaaactcttagtctctgttcaagttcatatggtgtcttggtttaagatattaagacattttaccacgtttttgggattgtacattcatattattgagttgctctgtgtaatgcaaaaaaattgggaattcattccttctaacaaggcactaatactgagattaagactatttattttaaccttagtaattgctacacataagcgaatttacgcctggatttcatctccttcatcccgtgccttttaggaacactatagctctctgaaaggtcttaccctcagctggatcggggatgggaacaatatcctgcactccatcatgatgagcgcagcgaaattcggaatgcaccttcaggcagctactccaaaggtagggaaactttttgccttgaaactaacccctctcttaaatcatcctcagatgcaattacccagtgacaaaaaaagctctcttccatttaagtatagcacaggtgaggccacagaatttaggttacgttaccagccctactattaaatagctatctggcctcttgagagtccaatttcccatctctacaataagagatagtcttggctgatgccttttattctatgagttagtgttaaaagcatgtctgaattattcctttgaataccctgctgtaggccattatgatgactggcattgtgcattaccaccacaaaggctgaagaaagcaataaaatccaggcagcatagaattctcaacccatgggaatgatactgtcatttttctaacactgcaatttggtagaaaaatgtgaatccaatgtgaggatcacagtgatggcatctacaccagcttagtatttcaaaactcaactctggggaccttttggcttagaaaatttgagccccacatggctatgaaaatgacccctgcatacttcctaccttgctgctctctcacagcatgtatggaatacatgacttctttcataggcccaatgtaaaccttttgatacacaagaaactggtaataattgttgcctctgaggagaggaactgggaggtttgaggatagaggtaggagggacactttattttgaccatacagtcatgtgtggcttcataacagggatatgttctgagaaatgggtccttcgatgactttgttgttgtgggaacatcataccgtgtacttacacaaacgtagatggtatatatttttatttatatatattctttcacatggaaaaataaatgttccagcaccattactaaatatcaaccttaggccaggcacaccaccacaggcacaccaccgtggggatttgtgtacaggtgatttattaaggaagtactgccaagggagatccctaagggattagggggagcaggacagggaaagggaagaatctaagcaaggatgccatttacagtgaccaaccatcctgatttgctcaagatcaagagatttctggggacatggggtttggggtgctaaaattgagagtccgggcaaaccaaggtgatttggtcaccctagtcccatgtcgtgcacagtcccacagaaagtagcttcagcctgatctcacaggtgagctctggagtgtaagttatgccctaaagttatcccagcattggtcaagggcagcagaagaggtggagtggtaaatcccctggcacttttgatgggaaaagcagcctggtagccagagagctgtcccctgaagacaaactgcacgcactaggtgttaaaaacactgaaactggggaagggagcagaagccatgaaaagggatcccccgggggcctctgagtagatcaccaacatcatctgctgcatccagccaaaacaaaactaaccaccaccaaatgcttcaccaggtgtttttatcttgctgtcttggattcttagggctgccataacaaattactacaaactacacagcttaaaacaatacaaatttactctttcacagttttggagactagaagtttgaaatcaaggtgttgacaggccacactccctcggaagcctctcagggaggatccttttttgcctcttcctgcttctggtagccccaggcattcccattttccctctgtgtctgtgtctctctgtacaaatccccctcttcttatagggacaccagacatattaaatttaggcccactctaatccagtatgaactcatcttaactaattacatctggaaagactctatttccacataaggtcacattctgagtttctgggtgggagtgaattttgaagaacactattcaaccaagtacacctgccatagaaaaaatgtactgcatgcagtggaagtcatcctattatagtaaatttgagggactcagagagatgacccttacaacagataattctcctcttttattcagcgtgaactgaaataagggtcagatccgatatgtgcttaaagcggcttttattcactttatgggaagggtgagtacactctctatacaaagctagtttgaagaaaggctctgtattaatgcaaactcttattgcatttggttcccacagatgaaacatacattaacaataattgctccctgctatgaagatcttttggaaggctttattctgttgaagaaatatatggtttaaacattttattgcatgccaaagatgttttattaacatcaaaggaaaaaattctaatattacagagtaattgcagtattgttcttaaggagaaactcatttaaatgataaagagtactaaaacctggttaaaccttggtgggagtaagagttttgcaaagtcttctggaaagtctgatagtgcaaaagtcattccatcaatttgtaagtcttcagttgttagtagacctgtttcctttaaagataaagctaggagatttattgtaaattttagaaacactgaaacgtttccaaggccatgattaatctatttccccattctttaaccaagaataacttacatgttcaagaaaaaataattttgtccatgattgtaaaattgctccataaactatcaatagtaatgattttaacattgttctaagtgaatacttagagtgaactgggtgtgttaatcaccttctttgtctggttttaaaatttatgtaaaggctagtgagtgatttagtattgaaagctgagatgtgagtaaagaattcctctctgtattctaagtcatgcctcagtgcatgcaaggttgggtgattttctaatttccagacctctctgttggttctctaagtacttattgattccttttctaagaattattgtacttagggagtataaaacctactctccaaagggaaggctaaattttcagggtaggaggcacctgggggaatatccaagtctcttcatttatgtttaccagtatggctgttcacaacattagttgctaaattagctagcctttattaattactttccccaaatctctataaacaaggctccagaattcatggctatatgagggtggtaaagctgctaaaatgtctgcaggcatcttcatcaacatctgagtagtttcttctttcaagaatgctttaatagaagaagaaactatggtagacaatcatgtgcaaataaacacaatttcacaaataaacctagacatgcctgtcacaggttgggtttcttgggaagcagactcagagtttagtgtgcaggacaggcaggatgcttattagcatgtgcccttgaaatcaacaactgtggaaaggaagggaaggaagcaggagtaagagggagaagctgagttgcgatgcagacccaacaacagccttggctgatcttatggaaagttctggatctgagatgtccattcatctgtctggagttgggcagaggagggtcaggttttcataccctcctgtcaatcagccattgaatgtgggttgccccaaaagggtgtgtgaccttgggtgcggctgctctctgcagcagaggcagtgcccaaagggggctgacagctgaaagccgtcttctggcagcactcccagcagctgggggaataagtcctttattcatgattattcctggagggggatctcgggagcataccacagcgttcaccacaatgcttcagtgaaaagtgataaaaatcaactcataatcaatgctaagaacttgggaaaatgagaaggatagaggaaggtgaggataattacagtgtttgaactgacaagacttccatatggagggtcttggaggtgaggctgggctagagttttgaggagctgacacattgtgatgaagaagcccaggaggggacaagagaggaggtgttcaagggtgaaaggctgtgatggcagaaaagggcaagatgtgtacagggatgacaataagattggctttcctgcagcaagatgttgagaagaattaaaagagacagaagcagaggatggaggtggggagccttgatgctcttaatcagctttgacttaagaaacaagtagtaaacatcagaggcttcagagaaaacagttcttgctgctgtgtacagaataggttggagagtgagggtagaggcagggaggctgcctgtgggaatctgggataccttggggagctttagctgttcccatgatgtctcctcacccagagtaggaactaggctgagcaagcgaggcacctagggtgcagaatttgtgcatgcatgaccctgagaatgtgtgtttctttacattttttctagcgcctccttaaatgttttgccctaggcacctcgcttgcctctccagagtctgactctgccctcaccaaaccatcccggacaaatatataatcttagcaaaaacaatgtatttgttctgtcaatgcctttcaaaacaagcaccctgccctcaaaaggcttgctggggaatgcaaaagaatgagaggtgtgtaatgggggagggggagctgttagtatttagctgggatggtcagggaaggtttttctgaggaggggacatttcaactgagacctgaaaaagttatccacatggaatgggtggaagaaagaatttcagacaagaaaggatagcatgtgcaaagatagacaaacatgcattcatttgcacacttctgaatataatcctcttaagccattatggaaaccggaagaggtgcttccaagagttagaaagcaccatgccttatgtttgcctttatgattaaagaagtcggagatagtgaaagctggggcaattggttgtctctttaaattccaaaaggcactattgagttttggaattctagatgtaaaaatcatattctactgaacatggtgggaccacatcttgaaaaagggaaggagacgcgatattgaaaagaaaataatatatatttaagaaaacatgtataataaaattacctaaataagatttaaattcttcctcctttagggttatgagccggatgctagtgtaaccaagttggcagagcagtatgccaaagaggtatgctctttacatgtaaagctattattgccttttactgtcccatgaagttatttaaccagcgtgtttatgtatgctagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaaggtacaaattgatgcctctctgaaggttcattaattccattcatgaaggccagaaccatctaatcacttattcactttagggggagcagactgtcctttcattccctataaaaggactcactgactgtatcccctagggacttctctccttccaaagattagctgtgtcctttggaaaggcatttttgtgctggatgaaggaatttgaaacccactgagaagagaggagcaggcttttccctctcacaagaatcgaggcattgcagtgttttactctttgtgtgtttagagaaattaggttacttctgatgcatgcagtttcttatgatttctcccctaagaaaagccccttaactatgctcctcaggctagtccttgcctctattttccaaggacctctaaatccagtttagttttgctaatgccctccagggcattcccaggggactcatctgtttggctgtcttccagtaagatctggaacaatgcttctcagtcttgagcaggtattagcatcaccagaggagttgttaatacacagctggctgggtcccacccccagggtttctgattcagtaggtcagggtgaaacctgagaatctgcatttctaccaagttcccaggtgatgcagtgctgctgcctccagggccacactttgagaagcaatgttctggaggaataccctgaaagccaaatgcacaggggttttgtcagcaaagcaacaaatctactttggtggagaaagggattaagcaagtacaattaatattatattgataaagtaatacataaatacaagttctttattgttatatataaaatagaacagaagtttgaaaaataaaaagtaaaaatgtctttctcccatctctttaacagagactattcctagaggtagcctctgtttaataatttgatgtgtctctttgcagaccttttctgtgcatttacatatgtatgcctcaatacacacataactattgatttttttgtaaatgatattttagacattacttatttatttattattattcttactttttccacttaacaaatcttagattttcttgctcactcatttagatattttttattctttttagttgctgcatagaattccaaaggataagtggaaccataatttacttaaaatgtttcctattgataaattaggctatttctgagaatgccgattacaaaaatgctgcaatgaacttgcttatccatatttctttgtgcaaatattactggagaataagatcctgaggagaggaattttggggtgaagtggtataaattttttaaaatatgagagtgctgctaaattgcttacccaaagaagattaaaaatgtatactgctgcagctgtatattatagttatttttccatatcctctccatgtttagcttttatttacatttttaatttttctaaatctggaggaaaaatggcacctcatctttgttaaaatttgcaattccttgattactaatgaagttaagcatctttttatgtttattgggcattgcccttttttctataaattgctattacattttttgcccattttctatttttttgccttttctattattggttataggagctctttatatattatggctaatcccttatcatgtggaatatattttcatggagatattttaaattatataaattgcttcatacttacacttgcttggccaatcttatatgtgttgctggtgctggaactgtaggattgaagaacagtcattttgttgatgtatggcatttataaatgttacttttttccatgtaattttgctggtattttagaaactcaaaatgtcctgaacctagagcttgggtgggaggtaaaacaaaattgtagtacaaaggcagtaattttgaggtaagaaagtatgaaggaatgtagttttgaatctgtatgtgaacaatagaaatatatagggaaatgtaactttcagcaattaactgttggagaaaattaaaactgctagtacatttgcattaagaatgaaaaatctaatgcatagtgcttataatcctgtttaattcacccctacctcattacctttatctaaattgttttaactagtgatggagtatgcttcaagtgctaaaaataataatttggagatcagctccaaatataatattatcacaccaaagcaactttttaaatatagtggactataattggtgacttttgctatcagccacatattacattagtagagttctttactgaaaggtctactgttccactaaatagaataacagaaaactgagttactggtgtaacttgaagtggtactctcttaaatttaaaaagaaaaaaaaaaaaaaaagacttgccagacacggtggctcatgcctgtaatcccagcactttgagaggcgaggcgggcggatcatttgaggtcaggagtttaaaaccagcctggccaatatggtgaaatcccgtctctactaaaaatacaaaaattcactgggcatggtggcacatgcctgtagtcccagctactcaggaagctgaggcaggagaattgcttgagctctggaggcggaggttgcagtcagccgagattttgccactgcactccagcctgggtgacagagcgagactctgtctcaaaaaaaaaaaaaaatttgaaagtaccatgtacatttctcctaggtgtcttgagataaaaccatcactctgctcctttgtctctccctttgcattgatgtctgactactggccatgtgtgtttttagatactgaagaaaacaaatatgactgccacatataatagtcaaaaagtggtcttatccccatctctttagactgctaaagttgctgcctctgactggacatttttacactgcttgcccagaaagccagaagaagtggatgatgaagtcttttattctcctcgatcactagtgttcccagaggcagaaaacagaaagtggacaatcatggtaagcaagaaacaaggaatggaggataagttctttgtgtggttccaacttggtcattcatgcctttggggaaataataagcaagtgagattatccaactacattacttgctcatgtaacatctatttttttccagaaactttataatacatcattagtgcttattagcatttatagtgtatttgcatggagtgagattaatctcctttcaaataaatccattttaaccaaaattcttaccacccttgatccgcctgagcaccagccaccagtttgccaaccattataagtcatataattcttattttagaatctctttgttcatgtttagagaagcccctaattcagttcctgtataaaatgggcattcaaaacatcttactttttcccttctctttttcctcattccatgccttactttatgactggactagatacttgttttcgttctttgagtttggccatagggatatatgtgtttttaggtatagaacatttccaaatttcatggcaaaacttatcttaaaaattaatggttcctttcagataaagccactagtttcatcttcatcactgtcattctaggaaatattaaccatatgtctactttacaatatcccaaatgtcacctgctctggaaaatagtactgacatgtctaacttagctccaccatttttttagcttttagtgacttaactggtctcaattactgtatcagccaggatcttacttgcaaacgggagtccactctaggtagataaatggaaagtaatgtattaagagacattaagcggctcccagaatcttttgggaaaggaagtgcagtgaataattcttggacaccatatagccagggacaacacaggcagaaaaattgcccaatgacactgtggttcttttgtagccagaacaccactgacacagcctggtacctgaggctcttgaaaccagatgtcagatactccattatagccaccacagctgaaatagatttctctacctgcatatgtagcagaagatccaatctctccgaagacggcttccactgcatgttgtttgcttctgcacccaagtctggagtagatgcagctgagtgggatgcctgtaccctagctgcaagggagtttgggaaaggcagtttttagctttcagcctctggagtagagaaaagcaagctggaaaggactagcttctaattatttatctaatctataaattggaataggtttattgtgaacattaaagtaatatgtgtaaagcttttagtatagtacataacacataacacatggtaaatattgttatcataattattaccctcattatcatcatcttcactattgatctgatacagaccctataaaataagcaggggttcaagctcaactatggctgcttggcagccaaccgtgactcccttttcaatagaagtttgtatattaggcctaaatttgtcatatctaataacagggatgattttttttcactgcatctttccagcttgccacctcaggacactaactttggccaaaatgtcaattgccttgttatctaggccagtacttctgaagccttaatgtgcatttaaattacctagggggtcttgttaaggtgcagatttgaattctgtaggtctaagatggagcttgagatttggcacatctattttttttttttgtttttttttgagatagagtctcgctctgttgcccaggctggagtgcagtggtgtgatctcggctcactgcaacctctgcctcccgggttcaagcaattttgctacctcagcctcacaagtagctgggattacaggcaggtgacaccatgcatagctaatttttgtatttttagtggcgggtaggggggtttcatcatgttgcccaggctggtctcgaactcctgacctcaaatgatccacccacctcagcctcgaaaagcactgggattacaggcgtgagccaccgtgccaggccggcacttctaataaggacccagttattgcaggtgccaccatcctgcagaccacattttgagtagcaaagatctagatgacaaagaaaatgtgagctctccaaccacatacctcaggaagagacacagcaaaacattttccttgagctctgtttttcatcagaagacaattgaagttacaaagatatatcaagtaaatccatcaaagtagatcctttgtagaaattcagtagggaaaactaaaaggaaactttccaaaacatcaattatggagatgctctgaacttcttatcttttaaagagcttattaaacaacgtctttaaaaccaatttacttgaaaaattaaatacgtaatgtattcacatggttgaaatatttatggtgaaatcttacatccacccatttttccatccatctagatcttaccgccatctccccattccccatacccctgagttacccactattattagaggaaaatattttaaagaaaccaagagacagaatcgtgttaaaatgaaagtagagagtctaaagtagaaagaatgctcacctgggagtgatgagacttgacttctgtaactggccttaatactagtcagctgtgccatcttagcgtctaagtattaactctctaggtcccagtgtcctctcccatgaaataagcagattgagccatagagatggcaaatgagttttaattcttagatccctaatctcatcaacaggctacaggaattctgttgagaaggattttgagcctgcctatggtgtgagacagaaagagtggcataactgattagcgtgccttacacggacgctagaaaggaggtggtgatacatgtgttgcgctctttatgtctctgagctagatgatttggaggtccctttgagttcagttcatttcagcagccatatagtgagcatctactctatgccaggtcctctgccaggcattggagattgaaaaaaagagaatagtatgcagccaccacacagcctgtacagttcatagaagcataacattttcaagtgggatgagaccttagagactatccacgctaaattcctattctataggcaaataaattattattattattttattattatttttattttttgagacagagtctcgctctgtcacccaggttggagtacaatggcacgatctcggctcactgcaacctccgcctcctgggttcaagtgattctcctgcctcagcctcccaagtagctgggattacaggtgcccgccactgtgcccggctaatttttgtatttttagtagaggcagggcttcaccatattggccaggctggtctcgaactcctgacctcaggagatccacctgcctcggcctcccaaagtgctgggattataggtgtgagccaccacagccggccgcaaataaattattcttatacagcttatttagaatggcctttaggttcagcactgccgtgatacatttttctaagatgttctaatacttgtcttcctccagactaccctatccaatacagtagccagtaggcacatatggctttttaaatttaaatctaagctaattaaaattttacaaaattgaagattcaggccaggcgcactggctcatgcctataatcccagcactttgggaggctgagacagggggattacttgaggtcaggagtttgagaccagcctggccaacatggtaaaactctgtctctactaaaaatacaaaaatattagcctggcatggtggcgcacatctgtaatcccagctactcaggaggctgaggcaggagaattgcttgaacctgggaggcagaggttgcagtgagccaagatcgtgccactgcactccagcctgggcgacagagcaagactccgtctcaaaacaaacaaacaagcaaacaaacaaaaaaagagaagattcagttcctcagttatactaaccaagttgttgaatgctcaatagccacatgtggctggtggctacactattggtattggacagcacagacatcgaacacttccatcactgccgagagctctattggacagcactactctagggaataatttccacgcatgcaacttgatttaaaatgaggatgaaataagaaaggaaagccacaatgtcgccctccagttctgagatgcctgtaatgactgatgtaaggtatacactaaaataggatgaagggctttttctttaatggtgtagcattttttaaagcagaagtgtcctctttcagcactcagagtagctttttaaggcctccatgctaagagatttccagtagtgctgttcagaacgcttcactaatcgcatcattctcttcatagtgcacaggtctttggacccctttgtttagaaacaaaaatcacacttttcctccccatgaagcttgcttttgtatttttcagtgattaataaggcagtaggactcacaaaaagtagatagatgttttccctctgcctataaattttacactggagctaaaataacctaaagggaccctgaaaaaaagaaaaaatgctgacacttcaaagcactgttatccacatatgactcttaagtccaaaacaccattgcaaatgtaattcacaatattttatagtcatttacttctccccaagttagagttgccagataaaatagaggacacccagttaaatttgaattttggataaacaatgaataatttttagtctaagtatgtctcatgtactatttagaacatacagtaaaatatatatttgttgttatctgaaattcttatttaactgtttgtccgtgtttatttaactgaatctgacaatcctaatccaagttgaatttgtaagtttttatttggaaataaggttgacacaatccatagacaattaaaaacaaagcaaaaatgagaggggctcccaggaacccattaagaagtttacagtgtcttttacctggtagacattcttatgccaaagtttgccctggctaaactagttccttcttgtcattcagacatcaccttaaatgttactgttgagcaagatcttcccacaccacccactcttaagtggttcccaaggctcctttatctcctttttacattttattttctaatggcactacttgatatttttatatttttttgtctgtttgttgcctgtccccctactataatgaaaacttctttatgaaggcagtaaacctgtctgtaacgttctttattatacctagaagtttgcctgacacatactttaaatatggactcaatacatttttgcagcctaaaggcaatatagggaattggttttagaacataagttttggaaatcaggttaaaattctggctctctctgtgatcttgggctcctaatcaacttaggcaagtaccttaacttcactaagaccagtttattcatatgaaaaatgaggataaaaaatagaaccaacctcttaaggttatgaggattcaatgagatcagagtcatgtgagcattgtagtcaggacccagggacaggtaggtgcagatccacctctcaccatcaccactcaggaaacttcctacatctcagtttctcgatctgtattttacatctcttaccatctcatacagtaggaaaggatattaaatggtatgatgtacatacagcactcagcaccgggcctggcatgtgataactttgataagtatattcagttaacacttttgaaatataagacctgcacttttgatataggctaggaacacatgtacagtgtggttgaagtgtaagaacaaggacctgagagaccacaaaactaccttttaagagtagagtcatccagattcacccatgttgtcacaaatgacaggatttccttttttaaggctgaatactattccattggatatatacaccacattttctctatccattcatccattgatggacacttaggttgattccatatcttagctattgtaaataatgctgcagtgaacatggaagtgcagatatccctgcaccagattggtttcagttcctttggatacatactaggaaatgggactgctggatcatatgggagttctagttttagttttttgaggaatctctatatcattttttataaaggctgtactaatttagattcccaccaacaatgcacaggagatccccccctctctgcattcctgtcaacacttatctttcatttttttaaaaataaaagccactctaataggtgtgtggtgatatctcattgtggtttaatttgcattgccctaatgattaatgatactcagcattttttcatgaacttgatgatttgtatgtcttctttggaaaaatgcctgttcaggtcctttgcccattttttaatcaggttgttttctttctctttagttgtttgagttccttatatattttggatattaatcccttaacagatgtatggtttacaaatattttgtcccattctgtggattgtctcttcactttattaattgtttcttttgctgtgcagaagctttgatgcaatttgatttgtctatgtttgtttctatcacttgtgttttcagggtcatatgtgaacaattacaagactcatgtcatagagcttgatatggtttggctgtgtccccacccaaatctcatattggattgtagctcccataattcccacatgttgtgggagggactggtgggagataattgaatcacaggggcagtttcccccatactgttcttatggtactgaataagtctcacgagatctgatggttttataagggaaaagccctgttgcttggttctcattctctctcttgcctgccaccatgtgaggcatgccttttgccttgtgcaatgattgtgaggcctccctagccattggaactgtgagtccattaaacctctttttctttataaatttcccagtctcgggtatgtctttatcagcagcgtgaaaaaggactaagacagagctttttccctatgttttcttttagtagtgttacagcttcagagcttatatttaagtctttaatccattttgagttgatttttatatggtgtgagacaagggtccaattttatttttctgcatgtggatatccagttttctcaacaccatttgctgaagagactgtcctttccccattatgtgttcttggcacctctgtcaaaaagcaattgaccataaatgcatgggttcatttctgggctttccttactgttttgttggttaatgtgtctgtttttatgacagtaccgtgtggtttttattaaaatgtctttataatatgttttaaaatcaaggagtgtgatgctgccagctttcttccttttgttcaagattgctttatctatgtgggttctttgtggttccctacaaacttaaggattgtatttttgatttatgtgaaaaatgacattggaattttgataggggttgcattgaatctgtagatcactttgggtggtgtggacatttttacattaattctttcaatccatgaacatgggatatcattccatttatttgtgtcttctttattttctttcatcagtgttttatagttttcagtaaacaggtcttttaccttcttgatacaatttatacctaagtaattttttgttgctgttgcaaatgtgattattttcttaattttcttttcagatagttcattattagtatattagaaatgttactgatttatgtatgtcgatttcattttctgcaattttactgaattcccttaccagttctaacagttttttggtggacattatgctaagtaaaataacccaggcacagaaagacaaatactacatgatctcacttatatgtggactctaaaaaagttgaactcatagaagtagagagtagaatgatgattaccagaggatgggggatgggaaggaaggcaatggggagttgttgatcaaagggtacaaagtttcaggtagacagggagaataggttttgagatctattatacagcagaatgattatagtcaataataatatatatctcaaaataacttagagaagaaatgtcaaatgtctctccataaaaaagataggtaagtaaggtgatggatatgttcattagcttgatttaatcattgcacattgtatacatatatcaaaacatcatgctgtactccataaatgtatacaattataatttatcaatcaaaaataataatttttaaaaagagtagagtcagagaaaaccagggttccaacccagttctgcactatctgtcatctcaaggattgatttcctcaactataaatgataataataaaagctaccttagaattttgttgtattaaatgagataatgcatgaacattttcctctagctcaccaaagctcctggcacagtgcttgaaaaatatttcttgaccaatacatgatatggtacttagtattctatctaatacctagtaagcactcagttaacattcaccatagtttctgatattattattgtcattcttgtggagattgagaaaagtaaaagtgaaaattaccatttgtgattgacagatcaaggggaagcggtatactcttggctatagagataatactctttcaggaatacccagcttcagagagcagacattgctcagattactctacatctgattcatcctaaacttctctaggctgcgagagatcaaaccacggtataaacacaaggatctggaataggagagatgatatttctctaaaactagccaatactatacttatgactggaaaattcagtcgtggctaccactgtagcatctcatttcaactctgtgacccactagtcctggaatgaggcctaattatgcagtgtttgtgtgtctagatcagtctgatctctgttgactttcatttataccctcctccaataaataaataaatattagttcagaactgttctcttaccattttcttgagaaaacacattttaactgtaaccctgcaaagctgaaacctaattcaccttctctaggtccctaagcagactgtcgctaatgtttatccatttctttctttctttgttgtgtcatcaggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttcaacataaaatactgtgttcataatgtataatgtctaagccattaagtgtaatctatgcttattacctaaataaattatcacccatgctaatttataagtaaacatttaccaggcagtcagctactggtaaatctgtgggctgtgttcctgtcccccaggaccaactagaaagccaaatgattcatcttgcagatgtggtacaattttcaggccaatgaggtagacaggcattcatttatggaggcaaataacgaaattcttaaaatatagctattactgtgcccaaactccaaagttttttccaataacttgtgagaatgtggtagtggggaatcctccaagagcatgtatctcttctctgtaatgagtacttactgttacaagccataagaagcttttgttagcaagtggtaaaagcatggatacctagagtagcattttcttaggttcaaattctccaacaagaataatttaatttttttcacatctgtgcttatcatgcatctactcacaccatatgctgaatatttccataaatctactacttgcaacattttagccaatctttttcctctaatttttctttggggtaataaaaatttacattattgaattattataatgtaattacaactagatttctcttgcgggtgactaacatttgtattgttgaattattatgatataatttgaattttttagttaaaatgttaaataacataagtgaagtttttttaaaaaattatacattttacagaagacaaaataatgtaatttcctttacattctacatttactattagaaaaatgtttccaggctggttgactgatattcttcagcacacagctctgacttaaatgagtaagcaagggatgaattacaaattagatttgcaatgaaggtgcaataaaacattttttgtgggggaaagaggctcataatgttacagaaaaaaacatcaaattttccagtaaatgtcaaaggtgacttttgtgtccatagtaatttattggaagcacttagaaagagagtggagtttagtggaatatctttcagcagagagtagaacaaggtgtcatatggattgtggaaggctcaccctcaaattgcctacatagaaagaagtgttcttccacttgccaaatggtctgccatagtaacgagctcccatctcattcctggttattctttgaactaaatggatggtatagtcttcttccctcacttggaaagaacttgtaataattttcttgccaaaatatagtcattttttcctcaaaaagctctatagctttctttattgtgtacatacaatttaacctcattctcagcccaattctgtaggaatgtatttgctttcttaacttttcatcttaatcagacattatttatattgtcaggaaaaaagaaaataggggaggaaaattcacccttaacttttgcaaagctgttttcatctcctctttcttcttaccccttttcctatatagctattacaactccgaagtttaacgaaaattctagaaatgacgcttgcatctttggtgtacataataaatcctgtcacctaatataactagccaaagagctcttttcttccaggatttctccacaataacattgggagtagacaccacaagtgattacactgcaatgatttcaatgtcatcagtttttgtttttgttttcagtgataagtttccaggtactttagaaaagtaattcagtgtctgggctgggcatggtggctcatgcctgtaattctggcactttgggagcccgaggtgggcagatcacccgaggtcaggagttcaagaccaccctggccaacatggtgaaactccccgtctctactaaaaaagtaccaaaattagctgggtgtggtggtgggcacctgtaatcccagctactcgggaggctgaggtgggagaattgcttgaaccccagaggcgaaagctgcagtgagctgagatcacaccactgccctccagcctaggtgacagagcgagactccgtcaaaagaaaaaaaaaattaatgtcagatatttctcattttttcttttctttcttttttttttttttgaaacagggtctcactttgtcacccaggctggagtgcagtggtatgttctcagctcactgcagcctctgcctcccgagttcaaagaattctcctgcctcagcctcccgagtagctgggactacaggcccgcaccaccatgcccagctaatttttgtatttttagtagagacagggtttcaccatgttagccaagctggtctcaaactcctgagctcaagtgatccactcacctcgacctcccaaagtgcttgggattacaggcgtgggccaccataactggcctcaatatcagatatttctatctggatattgtgctaattacttgactttggtaatgtccctgggtagaaagatctccacagagaatcagcatggcaatgccattgtagatctcctatacaagtgaccctagaacctcagttaaaatgtcagaggccccttggtccagtgccaaagttccatagcaagtcttctcatgtgataaagatgagtgaggactgcatatgaaaaaagtattcagaacacattccttttgagcctttttgtcttggaagctctcatcgatgtcttacatggagatgattgaggcatatctgagacatggtaccgctcggcaattttgtagggttgatatcctttgacaaatataaaggacatattaaataacagaaaaccactcaagtcacaatgatcagactcctataaccaagaatgccacatactgccttgcaggttgtggtttgtgtaaaggtctcaggtgaaagaaatgaataaaggttgagacccagtctgcacttcagttaccaagtcttgtgtagccaggaggaaggaaaaccttttttgtatgttgtccatggagagggggcactttttagtatttcatatacccgaataggtgctttgctttaaaccatacaaaggatcagtgtctagtaggggagaccctgccatcaacaacttacatttcagtatcaccttgtacttgagggcaatgagacacatgcaatgcactgatagttttggtgtcttgcctcagtttctgctaggttccttaagatgccatagtgaaaatgatagtgtctgtccattttgtgtggcaaacacgtgacacgaatcattgaaacaagtatttgagaatcaaccctgtagttatttaatattttaaagaaattcttccctaataattattcagaaaaattaaaatcattcattgataaaagaatcatggtcagataaaatggaattgaattccctgacatgtgctaaaacatttcacagtcttattaatgcctcacttatgtccatgacagtagacttagtctctaatacacacttttgtgaaactcatccccagagaaaatgcaagcacgactgccttctggagcaaaatcattaggcaaatgaattttcaaactggaacagagttttaaaaaatccagtctatcccttcatttcacaagagaaaaaaaactaggaaataacaacagtgttcctagtatagaaatatattcaatagagagggataattcatgtgttaaatgcccctctgcaaatgatctgggatcctacacatatagctgcttgatttgatttacccataggctgaatggggaacgggaagctggctggtccagggatatggctctataaggccgagggatagagaggaaaattcacaccttaggcagaggtggacactgatatccagagatacaaacagaaacctaaaattacatccatgtagtagatgctggtgatgccccatccagatgcctttcacctgggttcgtccatcccccagctgctgacagggttgcgtgctgatgtctcacagctgcctctttctttgaagtgctgctctcagccaccaggaactactgttagcccaggatgtcagactctcaccctaacctggccactagtagcctacagtcaatgagtgactgatatagggatataaaaacttggctcccttccctccaggcaggaccaggtgtgtgggtgaaatttcagccccagaactccacgtgggtgggatcaggctgaaactagtaaccatttgagaccacgtccttgcttagcttccctccacacacccgccccacccctctctgacacctcaacctgattcccttctgctgagagtgtgtcctcaataaatcactggcacaagaatccccatctcaggctacgttttagggaataaaatctaagatgatccatgaataagattttttgtgggtctgtactgctcatccttcaggcgtcaaggaggagtagagagctaagaggctattagacaaatgtggaagagctcatgttcagcaagcaaaaacttttccagttaccaggatcaaccttttgtagaagacagcagaatattaaaaataacaaatactatttttctgtcacatactcaaattcaaaacaggaaatttattacctgcatggaataggaatgagaccaatttactttccccagagaagaggagatttaagttaactgccacaatatttctgattaatttctgtggcattttagtacccttatagattggcaaccccagtagctgttcagttggtctgctccttgccctagcttcctgaggctgtgttggcatactttagtgcaagagtgtccaatcttttggcttctctgggccacattggaagaattatcttgggccacacataaaatacactaatactaatggtaactgaggagctaacaataaaaaattgcaaaaaaatctcataatgttttaagaaagtttacgaatttgtgttgggctgcattcaaagctgtcctgggccgcatgcagcccatgggccacgggttggacaagcacaagcttgttttcgtggttctccaacttaagtgtgcatcagaatcccctggagggcttgataatacacagattactgggccccacctgcaaagtatctgatttagcagatttgaagtgaggcctaagaatctgtactttaacaagttcttggggatgctgatgctgctggtccagggaccacactgagatcactggtctgagacaattctgaaggcttatatgaagggttttcacccccatatctgtaaaataccactataaagtatgtgacacaacccagattgtctgactattgctctttctttggagtcactgaggcctgagtttcatccttcctctactgtgtaacagttatccaaccctgctcttctgatctgtaaaatgagagtaatgctcatctcatggagttgttgggagaattaaatgcagtgacatatataatagtatttggcttagagcaaatgctcaacaaatattagcccccttttattttttcaattgtttttaacactattttttctttagccctttgtaaaaatttatatcccatcatcagaaagatattgagtggaatatttggtataaaaaaagtacaaggaatgagcttgtcttctgaaattggcagagcccagcagctgacactttatttagtcatttctgtctaggagctggtttgtaaatatgcaactcaggggagtgacttggctcattgccaaatggaatcatggaggccaacaagtctgaaaatccaatcaaggtgactaaattctgcttagaaaggcatcacaggaatatatatttatgtgaaataaatcaggggcatttagtaattgctggacttgaggtctagctggcaaaagaggaaaaagattaggaaggactcatcaaggtttattatccatctttgtctgagaatagcactgctcaaaagaggaagttttcacactgttcttaaggcagcagttctcaaaagttttggactcagaaactctttatgctcttataaattatgaagatcttaaaaagcttttatttatgtgggatatatcggtataagccacactagaaagtaaaacagaaattttagaaatatttatttattgattcatttattataacaataataaacatattacaggttaacataaggaacatattttatgagaaataactacattttccacaacaaaattaagttaatcaatggagtggccaaccttgttttatatctcaccttacattatatgtttttggaaaaaatgactattttaatagtctttgcagctaattgtggatatcttttgttgttacactaaaactccacaactgattataactccttaaagattagttgcaatgtggaatctgaaaccatataaattaacttttctacaccgttacattcaatttcatgtctatcttgccctttgaatggaccttttactcacacatgattccacattgatcatttggaaaatattagttcactgagttatacagatcttccaaatattggcacatttcattatataaaatcagaaaatcatatttgttaatagcactgctgatctcattagaaaaatctttaagcattgagaagtagatacacattttacacaattctagttttctcttgaatgctcaaattttgtctttgacaagaaataatgccaactgctttccttaaagtgacagctacactttgttcattttcaagatgtctgccaaatatccaagtttcaatgaccattttgtcagttgcttttttcccaagtaaaactggtgtcccatgtaaaaggtggctagttaaagcacaattcaaagaattgcaaaagtgcttttcttcaagacaaccatcatacttcattatgccacagaaggacttaatgctcacctcccatttcatcacacagaatattaaaaagatgtgtcctcatgaaattcaatattaacaatttttactgtttcatcaaatacttttttttttttttgagacagagtctcgctctgtcacccaggctggagtgcagtggtgtgatctcagctcactgcagcctctgcctcccaggttcaagtgattctcatgccacagcctcccgagtagctgggattacaggcacccgccaccatgcccagctaatttttgtatttttagtagagacgaggtttcaccatgttggccagactggtcccgaactcctggcctcaagtgactggactgatttggcctcccaaagtgctgggattacaggcgtgagccactgcccctggccattgaagacattcttaagtgaacttggcttttttgttaagtgcctctgtgcgatagtgaagaacacaatgatttttggttctactgctttgatttgtgctaaggtgtcagcaatttttctcaccatttcttttgcatcatctgctgatgctgctgttccagggaacaccctttgtaaagcatggccctatactgccttcagagatctaagagaggccaagaaggcagaactctggcttccatttttggaacaaccatttttgattaaacaagaacaaacgtttttgattaaacaagaacaactgaccccattctgattttttttttttttttgagacggagtcttgctccgtctcccagacaggagtgcagtggtgtgattttggctcactacaatgtctgcctccctggttcaagtgattctcctgcctcagcctcctgagtagctgggattacaggtgcctgccgccacgcctggctaatttttgcatttttagtagagacagggttttgccatgttggccagactggtctcgaactcctgacctcaagtaatccacctgcttcagtctcccaaagtgctgggattacaagcgtgagccaccaggcccagctctcattctggttttatctgtaatatttattagcattccctcaaaaagattctggtagaaaataaaaagtttatgatttactattataaaacaagtcttgactgtactatgaatacaatttacattgaagtttttaaaaaaaattctatgcatacaaagctgtctatttttagagccccaagtgtgtgccaagcattgtgttaagttctggggatacagtaattgacaagaaagacatgatcactgccctcatggtgcttatagtttagtaggggagactgacaaccacatgtaaatagatattgtgataagagctgtgtgggaaacaaattggatgctataatagaaaataaagggatgaaaggaaggataaacatttggattggtagttctcaaacttttatgggtgtcagaattaactggagagctaataaagaatacaattgtcctggcttaatcaaagtaaggaaagcctgggcctctgtatttttaccaaatgattttccaaatttcaagtagtactgctttaaatatagttcccagagcaagcctctcaaagaaggtgaccttaaactgagtcctgactgatgagaataattgggaaaaacaggcttttcattggatttggatcagatttgtctgaggtgatgccagtgcttcagctgtagggctgagaagtttatttatatcttaattaacccctttctatttcttattacaaatacatttgatcacttaagtgaatgactagagggattcctataacaaacgtgttttatgagcaagagtggttacactagatattttgtatttactaaccatgtcatggaacatctctctgaaagacttatcccattaacaagggacagatcacatatccttacctttaaaacctttcactgcaattggctctttttctgacaatgtcgttttacatagtcactgaacgataaattctgagttctctgaaactctcttcgttgtcttgctgagaagttaacaaccagcatgacactttgaattaattctcaaagtgcttatgctaataagattgtctcccctcaaggcttttcattaaatataattgtaaaaattacatttctttaaggccagtaaaagaaatcaaggtatttaatttctgatttccacataattaagtgaataatggaggggaagaatatttcagctagagggaatagtacataggttggccctgagatgaaagagggcttgtcttcttcatgggactggaagaagagagtatagctacagtatggtgagcaagagagagaggagcacaagacacatctgaaaagttcagcagggatcagtccatattggcctttgaggctaagataagaagtttggtttttattttatgttcaatgggaagccactgacacaacgtatccatcaaaagtgttctgtgaagacaaccttgagtttgtacaacacatctgtttataaaataggtacctgggaggacaatcaatattggcagaactagctccaggattctgagctccattttaccggttcatgcttcactctatctcttcatttctccattgttaattgttgccttcctctgcttctctgtattcacctccctattagtctttcaatgcattccatcctcctagtctttttttctcctggaagaattggaacttgggatcccatcttaagtgcaggatgaccttgagaaggaaaagaaactttttgtctgacgaatgcaagccctcttcaattatcaggcccagagaggtgttaaaatgcaacagcagtgaaatctcactcccacttgagctaaataattacatcttgagggcacttgctatatgggctctagactaactgaagccaagtagctatgaaatgccatatgctagacaccataattcatagccatagtttagcaatgcataaccaacctctaaccaatcttgttccggtaaaccagtgagaattcctgtcaaacaactttgtatcagaaaactctttgtccccttttgcctttaaaaatcttgtaacaaaaaggcccaaatggagcattccccaaggcaacttggaagtgtgtcctgggctgcaatcctcaatctttgcccaaataaactctctatgttaattttgtctccttttctttttttagtttgattagcctgaaggatgagaatatcagctattccaatcctactggtcctcttagctggatgaccttggctgagtcctatagcctcagacttctcatctgtaaacagaggatagtaataatgactacttatagaaatgtatgtgcaagtccagggaaatatttagagtatggcctgctacatagcacgtgctcaaaaatgttagtgacatatctcgtatttcctattcaaactttccatttttactgttatctcacattttgggcactttctgttcaaggagtatatcatttattttcaaatttaccatatcaccttgcattctgttgccactctgtaaatatttgttctgttttatacaattatgaaatgccaaaagacctaagaggagtgagaaaatgccacctgcaagactgataaggaaccccttcaggtcagtggatggatgtaacttgatcattgaaggactggcaacatttggatgggcaaagaaaaagaagggcattccagttggcatgactgttagtaaatgtgtgagatgaggatgttgatggtcagtgagtagtccacatgatttgaagtggaggatttgtttgtggaagtctttagtatgttagcacgaaagtgaggagcaccttcattaataaggtactaagtttggaatttttcctgcaggcactggggaacattgaacattttgacattaaagagggatataatgaaagcagtgcttcctcaagattaatctggtggtgttgtgtagatttacttaggaaactagtctcctggctagtttgttccctgaacaagggcagtagtcatgaaaacggaagatttgagccaagagaaaactgtcaggacttggcagttgaatctaaaagtcaaagaaaagaataatcaatttgaacttgaaattatcgtggtaggctgcagtggctcatcctgtaatcccagcattttgggaggcctaggcgggaggattgcttgagagcaggagttcaagaccagcctgagcaacatagcaacaacaacaacaacaaaaagccagtagttgtggcatgtgcctgtagtcctagctactcaggagactaaggtggaaggatggcttgagcccaggaagttggagctgcagtgagccatggttgtgccactgcactccagcctatgtgacagagtgaggccccaggtctgaaaaaaaattatcatgagatgtataaaagcaggccacttggcctctttcccttaatagttctatctttaaagcagagttaataaaatataacatcttagcttcacagagatgagaagaacttaagcaagatacttactgtgaagtatcaatatgataatagatgcaagagttcctagccccttgcctagcataaggaaagcaattaataaatgtttgttcattttatttttgtacttttggaaatagaacgctcatagacaaatcaaggcagtttgatagggggagagtagctaagggaaagaaaggattaaagaagatactgaatctatacttcttgtcttcaaatttgatttacattctaagacatcaaacaaacctatttgctgctcatgagtctgagagtagaatgaagaagagtaactacttagttacgattatttatggcttccctctccttccccttttattaggaaaatctcagctgaaacttacggctataaacatctgttttgctgacccaacacaacccaagttctttgataattaaattatttaaatgccttgggaagaagttatacatgtttaagtaagagcagacagttatttacaataataaaatacacagcccattcttttctctggacctgaccccttctctggtctctgaagaggccatgtccctcctcataccacttcaattttggccatagatacaacttccagtttccaggaatcacttccagtgttttttttctgagggcctttgtagtgttaaagccataccccctcctttttttggttatttctataagctctcttccaaagaactgagaatactttaacatgtagtcaataaaatgaatccacatcacaactctgtgtatctagcaggataaaacaatcccaagctttctaagaggctctcagagtgatatagagtgatagtagctcagttagtctcacttaaaagtgggaaatccccaccagaattgctaaaatgtaaaggcattgcagttcctagtgtatgtaaggataagatatggaacagctaaaattctttttttttttttttttttttgaaacagagtctcgctctgttacccaggctggagtgcagtggcgctgatctctgctcactgcaagctccgcctcccaggttcacgccattctcccacctcagcctcccaagtagctgggaccacaatcgcctgccaccacacccggctaatttttttttgtatttttagtagagatggggtttcaccatgttagctaggatggtctcgatctcctgacctcatgatccgcccgcctcagcctcccaaaatgctgggattacaggcttgagccccgtgcctggccctaaaattcttataccttgctggtgggactataaactggtacaaccacattgtagaactatttagcagtatctagcaaagctaacatccatatgtcctatgacccagtaatttaacttgatctggttggtggttacataactgtttgtaaggatgtattgagctgttgccttagtatttgtgcagtggggagtatttaaattttatctcaattaaaattataagtaaataaataactgtatatttgtaaacattaagaaaggtaaggaaatccaaagcaaaggaaataaatgagttgcccaagatcatctttagtctggatttggaaatgtattctactgcatcgcttcaactgaactgcctatcaaagaggaattacatttttaaatcatcgtatttgattaaagaaattgggcaccttctttattagaatgagggtctgaaccttctgcaattggtagattcaccaaatttctgctctgccaaactacgagaaaagagaggggttcaagattgaaagaccaggggaaagatggggaaaggaggaaaacaagagattgaaaagacattgctacttctcactcctactgctaaagctatctctaacatgggataattttggctagtatctttatttgatacccatttgacaaattcagattatctacaattcatacagtactttacattatattaagagtatatggtccctttttataaatgaagaggctatatatctcctcaagaagttgtctttgtttattcttgctgctgtaacaaaatatcagagactgggtaatttgtaaataacagaaatttatttctcacagttctggaagcaggaagtccagtaacaaagtgccagcagattcagtgtctggtgaaggctttgtctctgctttcaagatggtgctttgttgctatgtactcacttggcagaaggcagaagggcaaaaggggatgaacgctgtgtaaagcctctttaaaaaggcattaatcccattcacaatgaagaagccctcatgacctaatgactgcctaaagtccccaccttctaaaaccatcactttggggtttaagttccaacacatgaattttggagggacacacacattcaaatcatagcagcaatttatagtgatttttgatgtgttgcatatccttcagataaaagctcacagaaatctattcttgctaagtgagatcaacaatgaactctgaaaacaggttttcttaaccacccatgagaggcaatgaatatacctgagtggatcaattaactgcataaaattatacacagcattttatgtgtatattagtatttttttctgtgatgggaatcagagctttttgggaagccatgaatatgcacctctcagatctactgccaagagcatattgactgatggctccagcactgtgaaatccattactgagttgatgccaaggccacacttcccacagcttgctccaagacaatgacgcaggactcctctgatggcaactctggctcaagggctccctgatagccttgctgaactccctcagaactgtacttcagtctaagatgcatccactcaaccttcctctcatccttccttcctcccttctctctgtccttcacccagggtcagatctgctttgagccttccctggttccctcccaattttccctcacaggcactgtccttaatacatctcttccatgactaatcccatgtggtatctacttcttggtggagctggactatacaagtggtaccaggagttgtcctggttaacaggtggggtttagttagtccctagcacaaagtggtagctctattgctaaagatttcgctggtagtgacctgggaaaatgtcccaatagaggagttcagtggtcagaatcatgcttggatacaacttttaaagtaaaccacagtgctgtatcttacatgcgctactgtagagaacgaagtccagcacctggtaggtctctttgggttctagaagcagcacattccacccctatgaatattcctctagcctgtatacaaggtggcatgcaaggctgctggctttgagtaggatcctgagcaggaatataatctgcagcagatccaggttatggtacaggcaatcttgccacttgggccatacaatccagcaaaccatatgatattacaggtgttagtggtggaaaaagataccatgtggagtttatggcaagctccagtgggagcaaaacaatgtaggtcctaggagtctggagcaaggacctgccatccacagcaaaaaacattatgccttttgaaaaacaggtcccggcatgttactgggccccaataaagacaaaacacttgaccatgggtgtcaagtggccatgcagccagaactactcattatgagttgggttctttctgacccacccaagtcataaagtcggatagacctaccatcaatccatcatactatggaaatggtacatctaggaaggagtccaagcaagactcaagaacacaagtaaattgcatgagcaggtagctcagacccccatgtcatccataaatgatgcaccagttctccttccctggtttgcacctgtagccatatgaaggagagttcatatataaatagctgaaggagaataaacctctttcttggtttacagatgagtctgctttttatgtgactgaaagctaaacatgaacgatggcttcattgcaaccacattcaggagtggccctgaaagacagtgagagggaaaatctactaatgggaagctgaagtggtacatctggtcatctactttctgtggaaggagaagtagcctgaaataataatatatacggattcacaggcagtggccaatggtctgtccacctagtcagaagcctagaaatgaagactagatcagagaccagggatgcttgggtaggggtatgtagatggacatatgggagtgggtacaaagtatgaagatctttgtatcacacataaatatccaccagaatatatctgccacacaagcagacaaaatgactcagccagttgatattagccagcctttctcatcatccagcccagaattggcaccatggcatctacatggaggggtcattttggcagagatgtaggccaacaacacggaatcccatttaccaagattgatctagttaatgctgcctctgaacatccaacctgtcaacaagagacccatactgagctcccagatatgacactatcccttggtcagttgtcaagtcaaaaacactgggcgccttccattctgcaagggccagcagtttgtcctcacagggatagataaccattctaggcataggtttgctgttccttcctgcagaatctcagccagcatcactatcgagggattatgaaagtcctgattcataagcatggaatcccatgccacataacatctgaccagaagactcatgttactgcaaaggaggggtgagaatgaccccatgataatgagattcactggtcatatcaggtaccacagtgtccagaggcagctggcctcaaccaatgctggaatggtctttgaaaggggtaactaaattgttgctttgaaagcaacactctgaaagaaggaggcatcatccttcaggacacagtgtatgtattaaatatgagacttttatctggtgctgtgttcgcagtaggaaaaaatacatagatccagaggacaaagggtggaagcatgagtggcctcacttaccattggaggactttgtgcttcctgtcccatcaactctgggttctgcagagttggtggttatgttcctcaaagagggcacattcttgccaagggatgtaggaagggtcccatggaactctaagctatggctgccaccaggacacttagaactacttgtgtccaggggccagaaggcaagaagaggggtcacaattatggcaataattgatgccaatcatcaggaggaagtagggctgtttttatacaatgggagcatggaggaatgtgtgtgtgttgcccagataatacacttttgtgcctccaggtactctcttgcccatttatgactttgaatgggcaagtgtggtgactgcaacttcagaagcgtatgattcccaagggctcagacatctcaggaaagaagatttggattaaaccatcagggaaagccagtaaaacctgcacaggtgacagttgaggaagaggcagccccaagacctgctgcagaacaggggttgtaattcgtcttattaaccttcgtttactaagttttttcctcagaaaaagaggttcatggaaaccatgaaggatctgctccctgaccttgtgtggcaaagtagatctgtgcagtgcaaggagactgtgccagccatgagaatgtccctctcagacccgactatcaggattataattgacctactgctgctctgaaatccgtcagctcattgaagccatgccccccaccagctgctctcagccgtgagtaagtgcggcagggacactagggcaggtgcctcaatgggagatgcaggactcctctgacctgcccctgtggcctgaggactccttatcagctttgccaaaagtttcttagacatgcattaaagtctaaggcacttccacctagcctaccttcatttcatctctcctccaccgggggtcagaatctccttctcagtctgatggcactcctagcctaccctaagaatcggatggcactcctaaccacctctctctcaccattttccgtcacaggtctttccctcaatgactctcttgcacagttaatcccatctcagaggacctggatcaacacagctttcatcagatattcaaaaggtttatgacctaaaaaaggttgtatacaacccatttgccagatgctgagtttgcattcctgccttagaaaaaccagaaacacgatatggagccattcttgacccagatcaatgctttctttcttgcagtatccttgatctaggtaagtaagattgtgctgaagcatctgagaaaataaatcaatgatggcagtaagtttaggccaaaaagcgatttatcttccctctggccaggcaggcaggtcacccttccaacagagtcagccttattatataaactaggaagactcagtggaatttcacaaaggcaattaagttggagaaatagtctgccttaaatttacttattaaaataatacattaacaatactaaatgtcctacctgaatcatccaagaatgcagtgctattagtcactccaagaacttgaagtgtaccacaaacacaaaggcatgagctttctctatcctgaaaaatgcagtgacaagggaagatgattgcaaaccatttctggagaaaattaaatacatacatttcaggttttagacagttaggctttttaaaaataaaatgtgtgcttcctaatcatccttgagcttttcccatgatattaatcgtgttctgccagcagggagagggacgatatctacctaatagatctgttgcccatggggaagtatttcagagcctggcaacttccccttctctgattagtgacaggactgattcagagtgctcctccttgacccatttattcatgggtatgccatcaagaatagttccaagctttctatttcatggcataataaaaaataaactcaagcaaaattcatactctgtcctctttctgtcccatttttgtcctggtaatatttcctgggtcttttcccctcaaaacatactgtatagaataaaaattttatttataaaaatgcattgtcccaaatccccccagttgtgagtccaacttaaagtagtgaagagtatgacatttcttgggtaatatgtgagcagaggagaagctggaggtgggggtctgggatataggtggagtgaagccttgttcaaagcgcaaaaagtcccaaatgatccttcttcaagagtaatgtctctgtggagcatgctggtgttcatggcaggatattaggatgaggagcctgctggaacatcagtagctgattgaagcttctcttcattcttgtctgtagctgttccaattgtcaaaatcatctagacattctctttgggacaaaaagttctgtgagtccatgccagttttgtaatttaatttatcaggagacccaattcaccaagtgactctagatcaagtatctaatctcttgcatctaaatttatctgtttgtaaaactgagattatattgattatctcttcctcatttcataggttcttataaaggggaaaatgcccaaattttaattgagtcaatattataagagccaaaaatagtgttaaaatctatgactcatgggattctttcagcattatccatgttggttttgcattcatcaaaaaaaaagtagctctgacagattttgaagatctagcttcaaacattgagtactttgagggaggaaaacgacaaggtaaaacgttgctagttaatgttactagtttaaaggcaacaatattactgttataaaaccatccctcacatagtgttatctttcaaaggagtacatttcacataactaaaattgaagttgacatcagcaacccatgcttgcatggatctaggcaaatcaggattccatgcaactcttgatcacacaccctgcttcaccattttcttctgattctccagcatagaagctctcaaacaagtctgtcatcagaagtccctccttgctgggcagaaaaagaaatagcaagaaaacagtccattttcgagggaatggggagggggaattgccagaaactttcatgtcaagaagtttgactccatcgcactataatctggctctcatctaccatattatatattaataaatctaaaaatatttcctaaattgttttgctactagcatatggagagtaatggttctcactggagacagaagcaagccatttgacatggaaataacaatagcttctgtctctagttggtcaaccgcagctccagcagtaattgagttggatgttttccaagtcttcattcacaaagaggtgttcataatgatgtctatgagagtactttttcctcttaaatttcacagagcacctttcaaaacaaaaatgatggtaaaaaattattttatatatatgtataattctgatacacacacatacatcttattatcaaatacaaagttttaataatggctgatacgcattaaataatttatttgaaattttgtaaatggcatatgccattccagacaggtaaattaggtttgggaaaaatatgttcatgtactttgagtgctatgagctagcttttgtattagagcacccattgtattctaccttgtattattgctctttgttaacaagttcatctccattagcttacaaaccttttgaatacaatggcagtatcttttatttctttgtattttctaaagcagtgaaatgtggttcatggggaggagctggtctgggaacagttggttgccagtttgcaacaagataagaacacacattaacagtaaatatttaagatcttttatagaaatgtactattaccatactgtctaagtgcatgatgagtatgctcgtctagtagaacaaggcataggccagattgagtgttgttgaactggctagaatgacttgcatgtggtgtgaactgtatacttgccctgggcagcagaaccatgtattggtctggcttgcaattaattaggaataaaaagaacaacaaaactggtgctttaatgcagatagtttgagaagcaccgctgtaaatcaggagttggcaaactatggcttgttagtcacatcttactggtcacctacctgttgttgtatataaagttttacgggaacacagtcatgcccattcatttattatatatgctgttttcacactacagaggcagagttgagtagctccaacagagactgtatggttctcaaagcctcaaatatttactatctggccctttacagaaaaggctttttgatccctgttctaaagcaactttttttgtttttttgcttgtttgtttgtttttgtttgttttgagacggagtctcgctcgtcacccaggctggagtgcagtggcgcaatcttggctcactgcaagctccgcctcccgggttcacgccattctcctgcctcagcctcccgagtagctgggactataggcgcccggcaccacgcccggctaattttttgtatttttagtagagacggggtttcaccgtgttagccaggatggtctcgatctcctgaactcgtgatccgcccgcctcggcctcccaaagtgctgggattacaggcatgagccacggcgcccggccagcagagtttttttaaaaaaactttatttgtctgtaattgacagtaagaaatgcattttacttagcaaacaagtagatacatacatatatctatctaaaagttttacaaaaaaaatttactcatactacgtgtgatgcactttgatatttctcttctattctgctttaattgtattaagaaataatattgaacacaacatagtaaatttatattacaaccaattagatttttacccataatttgaaaattattgctctagcacattgctttgcacataggaaacatttattgaataatttattaatatatattaatatcagagttatttaccttctatgtcacatagggtttactgatattcattattatccacaccttctaagttctctcttgtaccacaaggactgaaagcctggaaattatatttcccagattcttttgccatcatagttccagttagagtttgatatgagagacattgaaagtggaatgaaggaggagctattattccacaatggaaggcaatgggcatcagcagacaaagacaaaaagcatggggttttgccacacacttccaggcatctgccttagcattcctctcttcagtgctgcaggcagctgatatcattggtggtagcttccctgtaattcaacatatttggtgagatctagatcattcatcacattttgtcatggttatgtttgggatatttggggcttcctagtcaattccacttgagaagaagtgttcaaaaaaggaattaactagagaaagaaattaattccattttctaggcagtatatgggataatcaatgacttgaggaaagacccctccaactggtgaaaaatttgaggggagaattacagaaaggaagagttatagtcagtagtgtgctggtaaatgtttagcaactggctctcccagggggaaaaaatccatgatttacagggtttgactatttccatggtgtaaataatcccacaatggccaatatcaagctagcaatgtggaatcaatgaatgtgaagttggaaaggggtgcccacaatcagttctgcaggttagtgggagctggctacaacacattagatataatcttactagtggggtgtccagggcagccgcagcttgtatctgttgtccataccagccatctttcacttcccagagtattttatttaatagagtctattctttttatgcacagtagttatgttctataaattcactgcaaacaccaaattggtgaatactgaactatcactcctagggaaaacataaggtcaggttcctgcaaggctctggtaacatttttatcaaccaatcaatacattaccttgttttctgtgtgttcttgtttaaagacaccttatttaatgtatattgttggttcattatacattaacatatagttatagattatacactgagctcacggccaacagcactatctcacgcctgaaggagacttatctgacatatacattttctttttaagaaatattataggccgggttcggtggctcacacctgtaatcccagcactttgggaggccaaggcgggtggatcactaggtcaggatatcgagaccatcctggctaacatgttgaaaccccgtctctagtaaaaatacaaaaaaatagccgggtgtggtggtgggcgcctgtagtcctagctactcaggaggctgaggcagaagaatggtgtgaacccgggaggcggagcttgaagtgagcagagatcggcgccactgcactccagcctgggcggcagagcaagactccatctcaaaaaaaaaaaaaaaagaagaaaaaaagaaaaaaaaaagaaatattatagccttcttgtgtttatgagcaataggcagcacttcagcactatatataggggccactttaaacagcaaaatcattaagtaaaagcacaaaaatgaggaaaatgtggcactaaacagaccatgaaaagaacacttgtttacagtgtaagagctgaaacaaataggcagggtgtcaccttgttcaacctaagcaaggagaatgcatgttgagtgggtaaaattttttgtcactctgagcatgtctatgaacaatggcaaaagcaccacaagtatagattttggtgttatgaatacattttagcaagcaagcaaatctgtaaatacagtatccatgaataatgaaaattgactgtatattatgattaccctagttattttttaaagatttttattgatacataataactgtacatatttatggggtacatgtgatattttgatacatgcatacaatgcgtagtgatcaaatcagggtaattaagatatccatcacttcaaacatttatcatttctttgtgttggaacatttcgaatctccaactattttgaaatatatagtaaattactgttaactatagtcaccccactgtgctattgaacactagaacttattccttcttatctaactgtatttttatatccagtagtcaaccactcttcatcctcccttccccattacccttctcagcttctggcaaccatcattctactttctacttctatgagatcaacttttttagctcgcacatgggtgagaacacacaatattcatctttctgtgcctggcttattccacttaatataatgtattccagttccattcatgttgctgaaaatgacagaatttcattcttttttgaccaaataatattccattgtgtatatataccacattttaaaaataagttcaactcttatattggattcaggaggtacatgtgcaggtttgtgaactgaatatattgcatgatgctgaggtttgggatacaattgatcccatcacccgggtactgagcatagtacccaataggtagtttttcaacccctgctcccctcctacctcctccccagtagtcttcagtgtctattgtccacaaatacccattgttcatctcccacttataagcaagaacatgtggtatttggtgttctgttcctgtgttagctcacttagagtaatggcctccggctgcatccatgttgctgcaaaggaaatgactccgttgtatctgatagcttcattgtatttcatggtgtatatgaaccacattttctttatccaatccacgctgatgggttgattccatgtctttgctattgtggatagtggtgtgatgagcatatgagtgcattagtcttttggtaaaacgatgtatttcttttgcgtatatatccagccaatgtgattgctgggtcaaatggcaattctcttttatttttaagttctttgaaacatctccaaactgctttccacagtggctgaactaacatttccttgaacagcatataagcattcccttttctctgcaacctcgccagcatctgctattttttgactttttaataatagcggctctgattggtatgagatggtatcccactgtggttttgatttgcatttctctgatgattagtgatgctgataattttttcatatgtttgctggccatttgtatgtcttcttttgagaagtgtctggtcatgtcttttgtccatttttcagtggggttgttttttgcttgttcaattgtataatttccttatagattctggatattagacctttgtcagatgcagatgcacagtttgcaaatattttctcccactctgtaggttgtttactctgttgatagtttcttttgctgtgcacaagctctttagtttaattaggtcccacttttcaatttttgtttttgtcgcaattgctttttttttttctttttttgagacagtttcattcttgctgcccaggccggagtacaatggcacgatcttggctcactgcagcctccacctcccgggttcaagcgattctcctgcctcagcctcccaagtagctgggattacaggaatgcgctaccacacccggctaattttgtattttttctttagtagagacaggctttcaccatgttggtcaggctggtcttgaacacctgacctcaagtgatccacccacctcggcctcccaaaatgctgggattacaggccaccgcacccagcctgcaatggtttttaaggatgtggtcataaattctttcccaaggctgatatccagaaaggtatttgctaggttttgttctaggattattaaagtttgaagccttacacttaaatctttaattcttcttgagttaatttttgtatatggtaaaaggtagggggccagtttcattcttctgcatatgactagccagctatcccagcaccatttgttgaatatggaatcctttccccattgcttattgttgttgactttgtcaaagatcagttggctacagttgtatggctttatttctgggtcctctatgacattctattggtctatgtgtctgtttttgtaccagtaccatgctgttttggttactgaagacttgtagtatagtttgaagttgagtaatgagacaacttcagttttcttcttttccttagtactgctttggctattagagctcctttttggttccatatgaattttaggatagttttttttttttaatttctgtgagaaatgacatgggtagcttgaaaggaatatcattgaatccgtggactgctttaagcaatatggccattttaactacattgatccttgcaattcatgatcatggaatgtttttgcgtttgtttgtgttatctaggatttctttaccgatttggctctcagcttgaatcttattgaataccatactttatttattcaccctttgatggacacttaagttgattccatgtcttggctattatgaacagtgctgcaacaaacatgggagtgcagatatctctttgctaaattgacttcctttcttttggatatatacccaggagtcagatatgtgaatcatatggtagttctaagttttttgaggaaactccatactgttttccatagtgactgtactaattaacattcccaccaacagtgtaaaagcattaccttttctccacatcctcatcagcatctgttattgtttgtctttttggtaatagccatttaactgaagtaagataagatctcatggtggttttgatttgcatttttctgataatgagtgatatcaaacaatttttcatatgcttcttggccatttgtatgtcttcttttgagaaatgtctattcagatcatttgcccatttttaattggattatttttgttttctgtttttgctattgagttgtttgagtttcttacaaattctggttattaaccccttgcgaaatggatagcttgaaaatattttcttccattctgtaagttttctcttcagtctgttgatcgttttccatgctgtgcagaagctttttagtttgatgtaattccattagtctatttttgcttttgttatctgtgcttttatggtcttgccccaaaatctttactcagatcaatttccagaagtgtttctctaatgttttcttctagtagtttcatagtttcaggtcttacatttaagtcaatctattttaagttgattttttttttttttgagacagcgtcttgctctgtcacccaggctggagtgcagtggcatgatcatggctcactgcatcctacctcagcctcccaagtagctgggactacaagcacatgccaccatgcctggataacactttaattttgtgtgtgtttgtatgtagagacaggatctccctatattactcagggtggtctcaatctcctggactcaagtaatgcttccacctaggcctcctaaagtgctgtcattataggcatgagccaccgcacctgacttaagttgatttttgtatatgatgagaaacagaggtctagtttcattcttttgcatatggatatccagttttccctgcatcattttttgaagggactgttttttttttcccaaatataagtttttggtgcctttgcaggaaatgagttagctgtaaatacatggatttatttccgggttctctactctgttctattggtctatgtatctgtttttatgtcagtacaatgctgttttgattaccattgctttgtagtacatttttaagtcaaatggtgttatgccccagctttgttctttctgctaagaattgcttcagctattcacagtctcttgtggtttcatacagatttcaggatgttttttccatttatattaagaatgtcattggtattttgataggaattgcattggatctacagatcactttggatagtatggacattttaataatattaattctaccaatccatgagaatgggatatcttttttttctttgtttcctctttgacctctttcatcagtgttttgtagttttcattatagatatatttcacttctttggttaactttatttctaggtatttttttgtagctattataaatgggaatgctttcttgatttctttttcagatttttttgctgttggtatgtagaaatgctactgatatttgtatggcgattctgtatcctgctatgtcattgaattcaattatcagttttaacagggttttttttttttttggtagagtatttagttttcctaatataggattatgtcatctgtgaacaaggctaattttactttttcctttccaatttggatgccctttatttctttctcttgcctaattgctctggctaggacttccagttccatgttaagtaacagtggtaaaagcaccacccttgttttgtttcagatcttagaggaaagaccttcaatttttcctcattcaatatgatgttgactgtggatttgtcatatatggcctttagtgattttaggtatattccttctatacctagtttgttgagagttcaccctagttatcaagtgacaaaagtcattaggtttttttcatgggtagaaaggataggaactctgaaataattagttagagaggaagaaagatttaaaattttgccaagattttgttgaagataattttatgtttaaaatcaacttaaaggagctgcaaggggccagacagattgaatttgttacaagttttatccttttctggagttcctgaagctcagaattctaaccaaatcttgcatctcactgtgggtgttttagtgtgccagctggaaaatgggatgaacaaatagggtccctatggcctctatcctgaggactctgttggaattgatggcaacatcagcctgcttcttattggttttcaaagtgagggaagaattcaaaaatcctaaatgctgggagcatccttatgaagtctggtcttttggttgggtctattgaagattcagactggtactgaaaggatttatcgcttgcatgtcagatatgtttttcctatttatactcttcactcctctctaccatgctctttgccccaggagctgacttttatagattgcatcaacagaatactttgtcttctgattcctggctgtctaacggtagacacatgtagatcattgcatgggaatggagtgaagtcagagtatttattcccttggtttcttctcttctgagttgccacaggttggcagtggttgtatttctccaccaaaggccacaactcccattgcttggccttctcttatagctacagttgtctctctatgttccagtaattgctccctttacctcttcaagctctgggttagtggcatccttctccactacactttgtcttagccaaaaggtcgagaagcaataatggcatccttgtgggactcctagggtacctcattattccttgttggttttccttaaacacttccataccatgataagcagtctttttattaaactgtcctcaactgtcttatttggctgtgccatattgtttccttctgtgacctgactgatgacattgggttcaggtgttgtaagtctgtttcttccattataaaggtccccattgacatccacctaatgatgttaataggttttgatgattgctgctagaaatgccaagcaccaattatgtcattacctaaagtatagcttgtacaagaaatagaataaatgtttgattatgtctctttattgatttttcagaagagttgatgttctagtaacctccaaagaagcctcccttttttcaaataatattgtgaattcataaatatgtacatatctggtgtgcttcgttatttcttttgatgctcaaattgtcccatctttcaccagcagtagccccctcatgctgttgcctttttgtcatgacctcaataggcttcaatagcttccttgctctgtggaacaatgtgatgtctcagattctttttatatatttctgctccagacgtggaaccaaacattactctaaggagccctgattcctttttgtggcaaatgctatttagagaccataattgggacattagggattctagtttctacaggattttcattgcttctacattttttcagtgaagagaattacaaaatgtgtacatttttagaaagtgaaaagcaaatcatgagtttatactgttagttccaaggaaaaatttaagattactgggtttttaacttattttagatgtgtatcccttttctcttaaatggaaaatatcctaataatattaacatattaataactgatcatttgattttcctgctttatatgtcatagtctcaaaaataacaatattattattaaaaacaagactattgagtgtagtgtaagatttctttgaggttatttggtctttaggatatattcctcaaagaatttaagggggttaaaagggtttcatttaaaaatcacttgaaatagtacttctgtggttgtgccaccaaactgaactataattagatttcatcactacaatctaatttaattttggttttgtgtaaaaattattctatgattctgaagtcaaaattatagaataaggtacattcagagagtcctaacttccttcattgttcttgttcacatatccccacatatttccttccccctcctctaagtaatatttctttattaattttttccttccattgtttcttattgaagcaagtgtgtgtgtgtgtgtgtgtgtgtgtgtgtgtgtcccaagaccttttttgtgccaaaggtggcaagctatacgtattttacttcaccttgctttttttggttttaacagtatatcttggagattacctacaatggtataaagagatcgtcctcattcttttcaacataaactagtccttcattgattagatgtagcatagtttattcaaccagtctccttgagggtcgtttgggttatttccaagcttgtgctactacaaatagtggtgaagtgaagtttttggtatatgtcatcttgaatttttcctagacttctagaaatgaaattgctggtcaaaggataaatacatatgtaatttttttaatgttacaaattcttctccagaaacattgcacttccaatgagaatgcctgtttcctcacaacatcaccaatggagtatgttgtcaaaccttgagattcgttttgcccctgaatgggtgagaaatagtatctctgtgtagtttaaatttggatgtgtttatcttaccatgattaagtagagcatccttgcatgtgcttgaggttcatttgtatatctatttttatagacagtctgtctctttaagacagaagagatttaaatgctcttcaaattatgtaacatgaatgtcttagtttcagtgccccagaggctgaccgtaagacaaggattcatgtgatcatgaattattagcaggtatttccacgaaaaggcagtatactaaatgaaaaatgggacaagaaaaagaaggaggctaagccagggtgtgacagcaaacaaggttccagagaatattgctctgggtcaatctcataggggagttatggagaccatgtgaaacacatctcagaattgtcccctacaggtggcaaggggggtagaatatttttttcttttcactgtctgtcactgattggttaagggctgctctcaggggacacaggcccccaggcatttccagctctttatatcgctgggcaaatcaggcttcaactgcctgagagcagtcatccaactaagaaatgtagatattggaaatgaaagccttcagggagctagaaagcatgaacatggcgaagagattgaagaggttatgggtagagcactggcggcaactactttaatgagtgactacccattccacactcacaggaggtcagcaccgtacaaaagagacatgtatcagggatgatttcaatataaatatccatgtccatgatagatgagacaatattattggcatcttatgtacttgatctgactttataacgatttgctaatcacatgtgttaaaagaaaattatgatgtattatgtacacccagttttccctagtcacacagtgttgagtcaaatgtctcctttgagggtaccttagaattttcactgatgcatagggtaatccctttgtgtgaaatcaacacccagacctatgttggaattaaaccagagttcccctgacactagcaagaggaataaacagagctttgttttctcagctaatgagagcaaacagttctatcccaggtggccttccttggaggtttttcaactataagataatcacacacaggccagaggtacagctcaacaatcctgaatgagaaaccaggaaaggaatagaacagaataccttgcttgaaactatcaaatattttagccagtggcaagaagtttactgacaaagcaggttttatctcttaggcctttgaccctggttttcatgttttgatttataggaggacctaaagagctctcagatttcaacatcacagagagcagaaagctgttcctcatttcatttattttattattacttaaaattagtgagtggaaacaggctacaggagaagagctaacatgaatggaaattgaccaggatgtaatttctccacatccgtatttttttcctcctcaattctaaacttgaattttgatcaattctggggtgaccgtcttatctggatttgcctgggattttcccaattttagcactgaaagtttcagacatagggcacactggaatggttgtttagccattttgtgaataattctggttatattactggtttaggacggggcttctcatggtaaactgcattcaaattccacgaatttcctgttaacatgcagattctgattcaacagggctggggtggggcctgagagtctacatttctagttttcaggtgatattgatgcttctggtccatctgtggaccacacttgaagtagcaagggtcaacggtagggataatattgatcctaagttttgttgcacatttcaacatttgaaatttaattttagtttataactacctttttgtttttttttttttttttttgagacggagtctcactctgtcgcccaggctggggtgcagtggcatgatctcggctcactgcaacctccacctctcaggttcaagtgattctcctgcctcagcctcccgagtagctgggattacaggggtatgccatgactcccggctaatttttgcatttttagtagagacagggttttgccatgttgaccaggctggcctcgaactcttgagctcatgtgatccatccgcctcagcctcccaaagtgctgggattacaggcgtgagcccagctaaaattaacccagctaaaattagcccgaccctagtttattgaactttgaacttaaggaaagaaaagccttggcctcccaaagtgctgggattacaggcgtgagccaccatgcctggccctagtttattgaactttgaacgtaaggaaagaaaagtgtttatgtgataatcatatttctttatgactattcatggtgaaggaaagagaaattaatgtacttgccaatagagcatttatgtttatgaaaaagttaaaggaaaggtattcaacatacaaaaaattagcattttaattgatgcaaaaattgtagattgcagttgttgctatatgttttatattgtatcatttgtttagtttccttttttggattttgaacaaattttgaacttgatattttcttagataattttaattttattaacatgtctgcactgccaattgctagctcagtcacacacaggcaccatctgtaccttcaaatagaattgtatgttttttatccttattacaaggacatatttctatatatttcatatataagatatgaaagtacttaataagggttcttcctaaatttgttccctcaattccatatctgaaactttatttatttacttttctttgggcattcttcccagcagcaaatctcctttaaacaacacatttcattggtgtcatgagatagctttgattccaggaaagagcagggcttattgttactcacttccattgctactagtaacatgaaaagcgacatctaaatccatactatgtttttctaatgagtttttttagagttattttttgccaagtttctcaactacagggtgtccactgttaatcctatttgatcagtttctattttaggagaagactcatagaacacagcaaatatttcatttattgaacctctcacagttatgaactatcttcccaaatccaccaacttcattggatttctaaatctattaatggttagtaattgtgtttgtgtatgtgagatgcatgctgtattatatatacaaatatagatatatatacatgcatacatatacatacagttagttaaaaatacacattgctcttggctataatttttaaaaacccaaataagtttattttattttatttaaaaaatttatactctaccttgtacttctagtacatatagcttgtatggctgcatgtcatcctaaaaaatagaaagcattagatgaaagaaaattaaataaatcagaggataatgtgaagctaagagtaaacatagaagtagaaacaataataacattcgcatctagagtgtaagctttagaagtagatatgatagtgtctaggagataacagcagaccaactgatcaatatattgaataggagtatttcaatgtaatatttcatcttgttccactggcatcagtgccaagaacaaactagtatttgtccagtttggaaagaactgaaagaaaacttttcaaagcccaaagtttctctcccactctcttcccatacctttctttctttggaaagaaaatgaaactttttaatcaatgaaattgacatgtagtttatatacactaaaatgcacctattttaagtgtatattttgattagttttgacaaatgtataaacttgtgtaagcgttaacagttaagatgcaaaacatttcccaaacccctaagtacacccccattctagtcaatactccccacctctagccccaggaaaccactaatcttccttctgataccatggattcgatttatcttttctcaaatgtcatataaatggaatcacagggtgtatggtttttttcttgcccggattctttccttcagcataatggttttgagattcagatatgttatgtgtatcaaaagttcatttagttttttactagtgagtaatattccattgtgtggatataccacaatttgttcattcaccaattgatgggaaagtggttgtaagagaaggaaatttgggtaaaagatcatgtaaatctattagcttggctttatgaataacagaagatgtgaagagagtgagattcttgctaaaatattctttaactcagcaactaaatctctgtcttcttttctgtctctgggcctgttgcttcttttgttaattagtaataattttattatataaacttaaagtactttagatttagttaaattctcattggcaaatcaaagcatgccatatttatcatctttggctcaaatatcatccctgagtggcaggcagatggcagactgtgttatcctctatcagttgaaaaggaaacccctggaagtaagttaatattttgggctttagcagaaagctgggactgaaactaggaacacaacatacattttcaaagcccaaagtttctctcccactctcttcctatacctttattctgaaagagggggagtgaacagaatagccaaagtactgcctccttcccctcgtccccaccccaatttcctcttcccacttcaacccaagcagcaggtctttaacctattttatatattgagcttctaagtaaaatttcatttgctgaaatatttctcaggttaagaaaactattgaaaacccattgaaccaaatctcataggaaaattaggattatttgttttaaaacacaaacttcagtgatataataatgtctttcacttacatggcactttctacttctttaaagagctctcacagacatttcatttagccagaagaataaagctaatcaataaatgtaattaattaagactatacattcacaaatgtcttaagtccaattaacatttaattatccttgttaatgggaaatggactgagtttgtgtgtgcaagatccacacacaagctaaaaacttaattacagcaagtggtttctaacttctgtctcatttaactttggctggaggtactaaaaagtacccatagtggttaaaaaattttttaaggcaatgtatataggttgcatttcctatctcttctacaagagaaaggtggtgaagtaaaataagaatattgagaacatgcatcttttaaacacacaaaaaataactttccaaaaaatgactgctagaatttgatatgatggtgacacatagttttaaaagtgacttaaaagtcttccaatgggcaaatactaaaacatcaacaacagtatagcttacctttgggcaactattgagatcaagaagacaggcaagccatgtacctaagcatggcaacaactggtcccaagttgcctggacagttatagttaatttttgttctggcataattgttaatagctccttctttaactctcagaagtgtcctgatttggatgataaattatatggtcatcctggctataaggaaacagcactgaaccatgactaagatgaaaaaaatattactttttcccatttttccttcctcaaaatttgagcatctgctcaaactggctttttttgtttttgttttttgagacagagtttcattcttgttgcccaggctggagtgcagtggcgcaatcttggctcactgcaaactccgcctcccgggttcaagcgattctcctgcctcagcctactaagtagctgggatcacaggcgcacatcaccatgcccagctaatttttttattttttattttaggagagacagggtttcaccatgttggccaggctggtctcgaactcctgacctcagatgatctgcctgcctcggcctcccaatgtgctgggattacaggcgtgagccactgcacccggccccagactggcttctttcattatctaaactatagatataatgaggtttcctctcctttctactaatttcaatcagtggtttgaaaacgtgggcattaatcagaatcactgagaagcttaaaaataccaatgtctgagaagaatcttggaacagttaagtcagcgtctctggaggtgggacgtaatcattgctactgattaaaagattcccagataattctaatatgcagccagggttgagaatcattgattctgacagtcactaaataattatttctattacaaaatacctggtattgtgagtgatgtatgaagtttaagatctccttggggaaaaagaatgtccctgcccaccatacttgaccatggcatacctttggctccatcctctgggtagccaaaggggctgctcattcctgttatcttcggatcacacaaagagtaataattctattttttcttccaaaatcttcattgtctgcaacgataatacagcaaagccaaatgaagacctcctttggcctgggataaaggcactttaagtgacagtgatagaggcatttgaagggaccttcaagttggccactcattatctaatggaagctctgacattctgaaagcttaggcaattgaagctaggtggcagtcctgcttagcaattaaaggagacaccataaagagaactataaagattcacacagaagaaaaccaaaaatgacttgccactgatttaacaccaacataggatcaacagggcaaaactaacttgctgtgttgtgcctttagatacagtcttcctcattaaagctcaggaatttccttaaaattataggcaactcttaaagtctgatgcttctaaataggctccatgacctctttacattctagtttaccggaagttaaccctactcccttatgcaaatgtctgcaaatagacactggtgaatctttaatcttctataaaatgaaagaatatgaggaagttatggagaatattgagaagcatctgaaatggtaatgcttgtgatacacaaaaccatgacaaactgtgattcttttaaaatttgtctataaagatgtttaccaaaatattcacagtgttcacctccaggtcagatgatttgtggggatttttatgttctttctaatacttttctgttttatttaacttgttttacaaaaagcgtatgccatcttatttaaaaattttactgtttttatgagtgtcaaaatgctgtttaactcactgaagtccattagtgattagataattagcagatcatgactgttttctgtgatgtctattctcagcccaaggcttgctatactttaattgatgattcctctaattaacattgttaatggatgacgctagtgtgtgtgcatcccagacaatcaatagattgtgcttatacttgctctaatttgaaaagctcaccagaagtagatgtttttgtttatttgctgctgttttagggaatacccaagatgaagatagggtctgttgagttgcatagatttcatacattttaaagtgtttaacaaactatcccttagatagaattttagaaattataaaagaaattgctatatcagaactaagagctcagaaagatttaataattcttctaaacacatgttcattaaattatttgagttaagcacagtatattaaggagtgaagttaggaatacaactgacagtaacagttgagtatcccaatggttgagcaacttctctcaaaaataatgtgtgattagatattgagtgagatttttctgtttccctggaattaaagttaaggcctaaagctgataataaaagactaaatagtaccctaaatctaagtttagatagccatctagagttgaggccagctgctccactgcaaagaatatgaactggaaattaaaaaaaaaaaacagaccctacccttcccttctcttagtatatactatgggagaactcagggagagtccgtgactctatatctgtaaagtaagccgttgtgacccttcaccattaccatcaacctttctctgattgccctcggggtgagggtacttccctttgtcaaaaccaagatgggagtttcaagagaatcactcatgaagttatagcctgttagaaaaggagactggaatttcactctctcattggatgtctccttaggccagactacttgctggactgtccctggaggagggaaatgagaattgggaggacgtggcaaggtagatgactacgaaacagagagggtgccaggaacaaactccacttaaattcatgtttcctgagagggccataagacagggcccacattaacaaaaagaaagtgcaactgggagcctcggtcctgcagcaccgctgcagtatgggaagcaagaggctgagtcacagaggaatgtgttgtgatagcacgagctgggagatctaaagagataatctagaatgtagcccagagatgggagataaaatctattaaagaaaaggttaaaagacatggtggaacacaactattcaaagagataatggataagaattttcccgaattgttgacaggcccaaacctcattataaaattcttataaatcccaaacaggaaaaataagaaaaatccacatcttcatatatcttggtgaaactgtgaattaacaaagacagaaaatatccaaagcaaccagagaggaaaagactaacaaacacttataaaagtatgaatgtcagaccaatagccaccattgaagccagaaggcagtggaatatctttaatattctgagattaagtaactgtcaaattggaatttcatacccacggaaactatatttcaagaacaaaaatgaaaaaaactttttttagacaaagaaaaataaaaggcttttatcagtagatcatcattaaattctaaaggattgtcattcaagcaggagaaaataatggcagacataaggtctgaaatgcaaaaaggaataataatggataaaatccaaattgagaatataaaaaaagtgaatataaagataataacatctaatctttaaacttaaaaataagatacaattaaaatacgggacaactatgtaagtacacaggatgatcatcagagataatacctgcaggaaacagctaccattccaaagacggggtgggaggggtgggaacaaatggaagtaattatcaggacctagaagcttggaggcaggaaccccagccttctaggaaggggtgctgcctggctggtgctagcatttcaggagcttgaagaggccctgcagagctgatcctcagacctctgaagaatgtgtactcttggctgctgctgttgtctctcaaggggcaagaacagtcagttgtgagaatgccaaagaaactggagataggaaccaacaaattgatgttgctggggcaatgttgccaggagcattatgcaaaaatgagaaagaatggtctcttctcctgccttacaatatccctatagggcccctgacttagtctgtgtagtgttgctatgaaggaatgcctgaaggggagtaatttataaagaaaagaggtgtttttgcctcacagttaagtaggatgtaaaaggagcatggtgccagcatctgcttctgatgagaacttcaggctgcttccattcatggcagaagggaaagaggagccatgatgtgcagagatcacatggcaagagaggaagcaagagagaggggagggaggtgccaggctctatttaacaaccagctctcatgggaactagtataaggagaactcactcattgccatgaggatggcaccaagacattcatgagagatctactcccatgacccaaacacctcctactaggccctacctccaacactggggattgtctttcaacatgaaatttggaggggacacacatccaaaccatatcattcaaccccattcccacatattcatgtccttctcaaattgcaaaatataatcatcctttcccaatagtccccccaaatcccattccagcatcaactcaaaagtccaaaatctcgtctgagactcaaggcaagttccttgcacctatgagtctgtaaagtcaaaaacaagttatttgcttccaagatacaatggtaatacaggcattgggtaaacattcccattccaaaatgaacaaatcagccaaaaggaaaaggtaacagaccccatacaatctgaaacccaacagtgcagacattacatcttaaagctctaaagtaatttttgactccatgtcctacatctagggcacactggtgtgagaggtgagctcccaaggtctcaggcagcctgactccatgactttgccaggctcagcccatatagctgctctcactggttggagttgaatgtttgtggcttttctagtctgaggttgcatgctgatggtggctctattaatctgggttctggagggtagggtcctgctcctgtggttctactaggcaatgctctagtggggactctctgtgggagctccaagcccacatttccccttggtatcaccttagtagagtctctctgtgggggcttcacagctgtggcaggcttcttcctgggagcccaagctttccaatacattctctgaaatctaagtggaaggcaccaagcctcctttactcttgcattctgggagccttcaggtttagcactaggtgaaagctgccaaggcttatggattgtaccctccagaaggccaagtggcctgagcagtatctggggccctttaagctgtgggtggagccaaagcagctgggatgtgaggagcagtatctcaaggtggtacaaggtagcagtgccccaggcttgtcccctaaaaccattctgtcctcctaggtctctgggcctgtgatgggaggggctgagtcaaagaattctgacatgcctttgggacctttttcccattgttctgactattatcacttggctcccttttagtcatgctgacctctttagcaagttgatgcaccatagcacccttaaattcctctcctgaaaatgctcttcccttctctaccacatggccaggctgctaattttccaaatttatatgttctgcttccatttcaattataaatttcaactttagattacttctttgctgccatatctgtttgtaagctgctaagagtagtcatgccacttcttgaatgctttattgttggagatatacttaatgctaaatgacgagttaatgggtgcagcacaccaacatggcacatgtatacatatgcaacaaacctgcacgttgtgcacatctaccctaaaacttaaagtacaataataataaaattaaaaaaaaaagaaaaaggggtcagttatgtagtcttcatcccttttatatttttctgtgactctttgaaaggactagcagacatttctgtaaagggccctatattcaaaactgtaggctttgagggccataagatctctgttgcaataaatccactcctcccttgcaggtgaaaacagcactagacaatatgtaagtatagataatatataagtgaatgtaagggctgtaagtgaatgagacccactgtattccaataaaattttatttacaacaacaacaacaaaaaagaaatttcttctgccagataccctaagtcatcactcttaagtatggctttccacaaagccctgggacatgggcacaattcagccaagttctttgctacagggtaacaagggctgcttttgctccagttcccaatcagctcctcatttccatctgagactttgtcagcctggcctttactatctatatttctgccagcattttgatcacatccatttaaccaatatttaagaagttccaaatttccccttgtctttctgtcttcttctgagccctccaaactcttcaacctctgcccgttacacagtttcaaagctgcttctacatattcaggtatctttatagcaacaccctgctacttggtaccaattttctgtattagtcagggtcctccaagaggaccagaactaataggacatatataaaacattaaaatgtataccatatatgtatatatacacacatacatacatacatgaaagggaatttattagggagaattagctcacacaattacaaggtggtgtcccataacaggctctctgccagggggagaaagatagaagctggtagcatggcccctagggaagctggtagcatggctcagtccaagtctgtaaggccccaaacctggaaacctgatagtgcatcccaattctaaggccaaaggcctcagagccctggggtggctgctggttcaagttccagagtccaaggctgaagaacctggagtctgatgtccaagggcatggggaggaaagggtatactgctctgagagacagagagcgagcaaaagaaagaagagcaagcaagctgaatacccccttcttcttcctgctttgttctatcaacactggcagcccattggatggtgcctactcacactgagtgggcagtcttcctctctcagtccactgactcacatgtcagtctcctctggaaacagccttacagacatgctcaggaacaatgctttaccagccatcaaggcatccctcaatggagtcaaattgacacaatgttaatcatcacatcccctctttggcaggtcctaacaaggagccagttggctgatgaaaaatgtaatttgcaggtcccagccccagcatcaccaagtggaatatagaagggtaggtttggagctgagctattaataactggaatgtgcattcagtaccagtttttcctgagtacaccattttaatctgtatattcaaggctcctttgatttcagcagtgttttcttgatttacatctatgaattttttttaattccattgtttggcccttagttgtttttttttcatgtgggctatagattggtgaaaagaaaccactccatgtacacaccatatggcgaaattaacttccagtttgtttaacatggcatatataaacctaacagtaggaaggtggctacacagtatagcttggctctgaattggtttcagaggtcctaactcccaccactaaactcttaacaggggctgccattgcccctttctgtacaagttggggtcctggtggatctaagaagctcaatttcatgtttgtaatccagggtaatactctgggaaaatactaataatgtcgtaaagatagctgtattttcctcattccaggcctaatttagaatcccaaatcccttctcctagtgtctgagaaaagaaatccaaataaaaacaaaacatattgaagatgaaaaacaatacagtgactagttttaagatccttctatttctggttctatttagagcccttgactaacaaacttgtcccctgatctttacctttacagatatcaagagtgactgggcacatgaagtccaattgaaggttgttttgtctgtatgctgatgcaaactttagttcacagaaaccttttggtctgtaaattgcattttgttttagggtttttgcttccctccatactgatgagtgttgtgggtggatttgtgagctctcactgctagttaagcatctgctattcatcatcctgatatagtcatcttttgcattttacttttcaaatggcaagcttcatcagaaattaagcactttttactagagacactatttgactcacaatctgacagattctaagcttaaagggaatcgcggggggggggagctgataataacatcagctacaggaagctgtcatgaatgggtttactaactcaactggagcccaaaatgaaaggaagaatatgaatattctcttgacctcactgtcttctggtgacactttagagctggctccatcaatttatattttcaattacacctgctttactggtccttcccctcacttatatttttacgtctatcctatattaaaaataattatatcctgcctcccacgagctgccaaactcactgcactcaaacttcttgaaagaattctcataatcttctcaccatttatccccttgaaatgtggatttcatttctgccacctttctgaaaccactcaccagtgtcacagataacctactaattctaaatccaattgctatatccttctttctattcctctccacctctctccctcttttgatgttcttaagcctctcttctcctgacttttatgacactgaagcctctttgttctcctaattctggatactccttctctgactcttgcactgattttcttcctcctcttgcttctaaaggctctccaagactctgtccttggttcttattttttctctctcttgaactttgatgaattaatcaaagtccattgttttacctacgaaacctatttctcttaatttagttatttcttcaagctctattcatatgtttacaacttcctgatggacattactccctgaataatccaacagcatatcaaactcaacaggtccaaaggtaaattcattatgtcctctcacaaattatctccttttcccaaaagctcaaagcctatctttgctcttcccagtatctaatcaattgccaaatttgtaagctctctgcctttgcaacattttcatctgcccccttattccattctcactaccactaccctactcccaatcctcacaatcattcatattgtcttttctaataaccttgcaatttatctttccctttccctcattcctttcctactccaacccatcatacccaacaaagtcaaattaatttcctgaaggagtgcaatgattactcacctgctcaaaaaccttagtagctcctacttctttttagttaagtgaaaatttaccatccctctgtttaagttcctctgtaatctatcccagtccatctatgcttggcttctaccataccctacaagaaaacggaattatttattgttccttagacctgtccccagattgtctacttccatgccttttttttcatgccactaccttcatctccgcttgttaaaaccctgaccaatattcagtataatttggacatcttctcttctgtcttctcttgtaaagacccggttgaaacttctgccaagagcccagctgaaactcccatcacagaaagtattatattgtgtatttgattatagttttctgtgaacttgttttatgtcactactcagactggaacctttatgttttattgagtaatacactgaacagtgtcagtgctccagataggttccttcagatttctttgccattttactatatgtgtccttcctccactgatttcaatgttctttgaattgccacctttcagtgggctcttctttgaaagctgccctcaggctattggagctattttgcccacaggtcagaggattagttctgagagttttcatccctcacctctacctggtggtgactgttaaccaatggctatagaatgtgggactttgaaagcacaactgtttgacttcaggatgatacaacttggaggcctcacactgcagaatttcctggcaggatcaggctgaagttacctcttgcagaatggctgccgaaattttgccctttcttcctctcctctgttcatctcatcttcataggaagatgagataggaatccatctttctgtctctcagggtctgctgcttgggaaacgtgactaggacaagtcatgtttttgagtacttgccatgtgtcaggcaccatgctaaatgtccacatatgtaatttcccttaatttaatcctcttaaccgcctggagagctaattattactctgattaatagatgagtgaactggactttgaagagattaagtaacttttttcaaggctatatagctaataagtggcaatgccaagagtccaaacaaggcttcagaggcagctcagtcaaccagtttgctatactccttctgaaactacttcatggaaaggagacttctaatatggccccgcatgagccctgtctcctggtattcacatccatgtacaattctctccccttgggtgtgagctggacctagtaatttgcccctaacaaatagaatgtggctaaagtgatttcacttccatgattagttatacaagactggcttctatcttgctagcagaacattttgctgcctttgattcatcaagttgctctgttggagaggcccatgtgacagggaattgagagtggcttccactcaagagctaatgaggaactgaggccctgaaacctgccagcaaccacataagtgagcttggaagtgagtccttccctgctggagccttgagatgaggctgcagccatagtcaacatcctgattgtagcacatgagagactctgtgccagggggctcagataagctgtgcctggatttctgacccagaaaaaataagagataataaattatatatatatttcatatatataaaatatcacacacacacacacatatatatatttgagacagggtctcactctgtcacctaggttgcaaccaccccctctggggttcaagctattttcatgcctcagcctcccgtgtagctgggactacaggcatgccataccggctaatttttgtatttttagtagagatgggatttcaccatgttgcccaggctggtctcgaactcctggcctcaagctatccacccgtctctgcctcccaaagtgctgggattacaggcatgagccaccacgcccaaacagagtgtggtattttttaaaagcctgctgcttggaaaacagagagtcaaccttgttattcagtgtaacacttgaaacctccagctcagtgacttaccaatagatgctaactaataatctatcacctctggtggttttatggtccaataaacttagctaggatggtggtgataaactgcttgaaaagcattaactttccaatgtgataggtacttgataaccttggaaccaagtaaacaacaaataaattaccagcgaggattgggtaaagatattattttaacgcatccaaaataagcctttggttttgtgcttgtttcaattaattaatcaatcgataagggacagtacaaattgggcaccagctggcttgttgctcaaccataagcaaagctgtgttcagtacctcccagtcaactgcatgtttcccaacgtgtgcctctctctgcccctgcatactcacccacatacagcacattgtcatgtaaatggaaatcaaccaaagatgtttttccaattctttattcctctggttgccatgggattacagatcagaagtcagagaagacagatgtaaaatagaaaaagatgcagccctccaactaccccagctgcctgaaagcatcctttgagtaggcaagaaaaggtaataatgagatggatgacattgagcgacagtctgtcactatgatggtaggagtagaagaaagctagaagataaaggcaaatgtataatgtcccttgacccacagagaaacctgcccaccttccgcatctttttcaaacagtggttggcaacaacttgggcaaccaactgtcctgatttgttggaaactgtcctcattttagcactgaaagtcctgtgttcctggaaatagctcaatcccagataaaccagaatggttggtcaccctagcaacaatcactaactcccaaagggctcagctcccattgatatttgctttttaattggaagagtcaataaaaagatatcttcttaaacttttctctttgaaagctgtaattatcctattggcagaatttattttttaaggtagtgccataaattctattcctcccactaaaaagtgaaaaaaatacattagaaggttttactaattttattcagatgttatatttgagctgaaaggtgggggaaggagacaggagagtgagtttggaggacagaaagctgtcaaaaatatggactaagggcatatttaaatttgctggtacattattaattgaagaaatcatttgtctgaattcaaaggcacaagttaaatatgtcagtagtcactctttaaactctaaagatctggaccctacaatctgcaaattttacagctagaagacaccttggaggtaatctaacccaaactcctgctttttagacagcattcaaagaagctcaaactttcattttgctgtctgttacagaacacagctttggggagctcttaatagttgttacatgataaaaaagtttccttggtcacataagtttaggaaatatcaaggtaagcaatgttaaacaagtttcttgactgcagaaattttctaggcattttatatgcttgcaatcagtgactctcattcaatgtacattagaatcacctgggggaacttttaaaagctataattgactaggccccaccaagatctaggaaacagaaaataatccctctctggatattgccgatgttcaccctgattaagaatcaccagctatattcctgagctctctattctgttccgttggtgtatgtatctgttttttatggcaataccacactgtttagttactacagctttataacgtattttgaagttaggtaatgtgataatccagtttgttctttttgcttagaatttctttgaatatttggggtccttgtggttcagtatgaattaggggttgtttttttctatttctgtgaaaaaaaaatcattgaaattttggtggagattgcattcaatctgtagattgctttggatagtatggacattttaacaatactagttcttccaatccatgaacacaggatatctttcaatttatttgtgtcttcttcaatttcattcagcaatgttttatagttttcagtgcacacgcatgccactttcttggttaagctgattttagacaaaggtgccaagacacacaatgggaaaagaacagtctcttcaataaacgatgttggaaccaccggatctccacttgcagaagaatgaaatcagacccttatctcacaccatacacaaaaataaacttaaaatggattaaagacttaaacatacctaaaattgtaaactactaaaagaaaaacagaggaaaacctccataacattggtctaggcaatgatttttttatatcactccaaaagcaaaaatagacaaatgaaattatatcacacaaaaaactacacagcaaaggaaacaatcaactgagtgaagaaacaatctacagaatgggagaatatatttgcaaaccatacatctaataagaagttaatatcaaaaatctataacacactcaaacaactcaatagcaagaaaacaaactgatttaaaaaaataaacaaagggcttgaatagacatttccccccaaaaaagacatataaatggccaacaggtatatgaaaaagatgcttaacatcactaatcattagggaaatgcaaattaaaaccacaatgaactatcacctcacacctgttagaatgactattatcaaaaacattaaatataagtgttggagaagatgtgggataaagggtacacttacacagtgtaggtgggaatataaattagtacagccattgtggaaaacagtatggaggttccccaaaaaacaaaaataaggccaagcacggtggctcacgtctgtaatcccagcactttgggaggccgaggcaggtggatcacgaggtcaagagatcgagatcatgctggccaacatggtgaaaccacatctctactaaaaaaatacaaaaattagctgggcatggtggcgtgcgcctgtaggcccagctactcgggaggctgaagcaggagaactgcttgaacccaggaggcggaggttgcagaaagccgagatcgcaccactgcactccagcctgctgacagagcaagactctgtctcaaaaacaacaacaacaaaaaccaaaaaaaaacaaaaatagaactaccatatgatccagaaatcccactacttgatatatatcccaaggatgtgaaatcagtatgtcaagaagatggctgcactcccatgttcattgcaacattattcacaatagccaaggtatggaatcaacctaagtgtcaacagatggatgaataaagacaatgtggtatatattggaatggaaaagaattaaatcttgtcatttgcaacaacatggatgaacctggaggacattatgttaagtgaaataacccaggcacagaaaggcaaatatcacatgttctcattcatatttgaaagctaaaaaagtgaactcatagaagtagagaatagaacagtgattaccaagggggtggggtgagggtaggggaaagactggggagaagttggtcaaaggagacagcatttcagttagacaggaggcatacgttcatgacatttattgtaaaacatggtgactatagttattaatgtattgtattcttgaaaattgctgagggtagattttatgttctcaccacaaaaaagctatgtgaggtaatgaatatgttaatcagctcaatttaactattctacatttgcatccatatttcgaaacaacatttgtacatgaaaaaatatatacgatttttgtcaattaaaaaataaaattggccaggcatggtggctcatgtctataatcctagcactttgggaggccaaggtgggtggatggcttgagcccaggagttcaagatcagcctgggcaacatggcgaaactttgtctctacaaaaaatacaaaaattagctgagtgtggtggcacgtgcctgtagtcccagctacttgggaggctgaggtggaaggatggcttgagcctgggaggcagacattgcagtgagccgaccttgtgccactgcactccagcttgggtaatagagcgagactgtcacacacaaaaaaattaaaattaatcaattttacaaagaactactggctaatatgtactgtgaatctatgagagtaaaaaaaaacagtctgcaatattttctaaccttatttgacaatacatatttttcttccttcctttgtttcttccttccttccttcttctctttcttccaccccctttctttctttttgttttggctttggaagatactggtttatatttgaggttttgtttgtttggtcaacaagaagagaaatagaaaattattaattatgtctctaaatatactttatttaaaaacagattatgctttatttaaatttttaatataaaaaaatttaaatcatatggagaactaaggagagtagaataataaactcttttgtactatcacttagtttcaacagttataaatgcatgaccatcttgattcacctatattctcacctacatcccccctttccccaccactgaattcttttgaagcaaaccccagataactatattattttattcataaatacttgaagatctatctgtaaaagattaaacactttaaaatataattgtactatatcacataaaaattaataattctttaatactgttaaatattcagtcagtatgcaaatttataagaattgacaccttcatgataatgaatcttcctaacctagaacatggtatgtcttttgatttgttcatgggcattttcatgtatttcagaaatgtgaatacattagtttttctcatgtaggttttgaaactttttaaagtaagttttcacctagttattgtattttacttattttggtttatcctttgccatttaaatgacgtcttctcttccattgtgttttctaacttcattgtttgtatatgtgaattttaatcagctttattaaggtctaatctacacgcaacaacatgcacagattttaagtacacagttcaatgagttttagtaaaaatatatacccatttaatcactatcctcacagttcaatgagttttagtaaaaatatatacccatttaatcaccatcctcactgatttttaaatgttgatttcataacctgctaacttactcaatttcacgttttaatatatactctcaaagttcttactagctttggccaattattaaaaggtatcacattccaatttctgtttttggttttgcttcttactcgatcccaccatgccaaaaagattttttccagtccatgttgtaatagaaataaattaaatgtcaaattgtgactgatcctagagatttaaattgctattacagacataaagaaacatgatcctctttgcaacaggtgtcatgctaaatacaagtttagtgatgtaagcagctaataataattagaatgtaagctgactcaagaatggatatccggctcattaatatttgcttcatagaaataggctcaaatgttcttctcgagtctgagtaggtacattccctggatgcttagaggaataaatttatgtccaagcccagcactaaggctatcattactcacagaactccatgtgacccctagctggaaaaatgtgtttaccaagccccagctgttgtatttatgaatgtttaggaagctgaaatgactggcattggtctcagtgcccctaaaatgtgacgagttttttgaaagttgcaaggcagccaactcactcacctagatgagactgaagaaaagcagtagcttttcatgggagtagaggctttccaggctgagtatcctctggggtcatcaacaccctgaggatagtctggtacctacctaggggcaagataatgagcaatatatagagcaaaggtggtgggggcaaaagggtgaggcatgctggttggaagaaaaaaaatgggttattccagaagttcttagagccgatagagactgtaaaacataatttaatacttgactcttgtctttgtatgaggtttggaaaaagtgggccttgagcaaggatttgactgcaattcgtttattggaagagggggtataatcttaggaagcatggcaaaagaaaagaaggaaaatcaatatactgggtgtaaatgaaagggttactactgtggacaactggggctcaatgtcactggccaccttctgagatattgggtaaaatatgcctcagaaatatcctgctgattgctgaggatgctcagatatgtatccactcatttccatccctaatcagtttagggtcactattagggacggggtggaagttaacacttgacacttctgtcctaccctactggcaaaccaagcatgctcccatggccagagagcgccctctggcaaataaccgtatgggtatgggacttatttacaggaaatttctagggtagagcaagaggataagagaactacaattttatattgcttatgttgctctctggttgttttttatgtgtgagttttatctcaccaacaacaatgaaaactctttgagtgtaggggctacagcttatatttgtgttgattcctcccataaattctggtgagctccttacaactgcaagattaaatccattaagcccttcatgattggggggccctgccttcctctccagacttttctttaccatccactttctcatcccaggcatcccagccattcctcaagtgccttctctctgcatagaataccccttcctcccgtgtccaatgggtcaacactgataatctgtcaggatcagctaagtagctcttctttcttaaagtattccaagttttccccaagtaatcatgccctcttttgcaaaccactacctggttcttacttctactgtacaatttatcatactgtactgaagtcctgcctatcagaacatgagctcattaagaaagtaatgtgtctttatccaaagcacccagttcagtgcctgctatggactcaatgctcaataaatacttttggaatgaattaatgaacgttaccaatagatactttctgattaaataaaacaaggagttggacataccctctttggataccctaaaattcccctcaaatatttgattgaatgtgtggtcaggaagaatattccccagaatagtgtgccaatgctcttcagccaaggatgaccaggaacatggctataattcaacaacatgggtttttactcattgcagtgaggaaacacacatcatgggggaccttacagtgtctcagtaagagtgtgttagaaagaaactattataaaattggggctttggatgaatgttggggaggggaacaaagaagcagggatttgctctcgatcagatgctgtcagaagtggggtcaatcctatgattgggcctgttgtgaaaggcacagtggctcggattttgtctgtgcttagacaaaattatgaagtgaccttgttttgtttcattttctaatggtctcaggttatctttatctgtgtttggtattctgtgaggttgtttatgtcccacaggaaaaaaaaatggcctggctgtgagcatttggtcagcctgtaataatactgaggtgtaactgtgaacatcggagaagttctgaacatcaggagatgctttttttgaggtgacgagagaaaggcccaaaagaataagattatatgtacaggtactgatagcagtcgcaagggtgaaatgagagctgaatagaagagactaaaaccgaaaagcaaactcgatcttccatcatgctctgtgacctttcaggttgagaagaatattaaatcctgaagctctgcttagtcctaaatgtatataatggctaaaataaatagattttttcaacagaaaagcaagaagcacagatcctcctttgaagatataaaccataagccctgaaaaattaaaatacttaatccagcagcaatatcacttgtgtagcaataaaataataggatttcctttgcctccttgttttggttattctctcttctaaaaaattgttgacatacttttgggtgataagagttagataacaaatctgaaagtatgtagtttgtattttggaataaaaaaggaatatagaattttctgttggttaaattgtttatgaagccctgcgactggaaatctaattccaaatggtcacttaaaagccattacactgtttattcaacaaattgttttagaacacttagtataagttaggtaccacggtagatgcaggagttatgaagatgaataaaacaaattcttgtactagaagagcttacagtccatcagaggagacaaacaatcactgacataaaacaaacctactaactccctgtcagagtttccacccctggcaaaggaagtgacagaacagttgccagacatagagaaagtatagccttgagcaactgggtcccaataaatagtcagtctgatttaaattatctgagattgatttttcagggacaactttttatttaaatataatttcaaacttacagaaaagttgcaataatagtacaagaactctggtttacctttcatccagatttaccaattgctttcctaaccatttgcaagcaagttagagatattgcgcccagcaatactaaatacttgagtgcatgttttctttctttaaatttttttttaattccataggtttttagggaacaggtggtatttggttacacaaggaagttctttagtagtaatttgtgagattttggtgcacccatcaccagagtagtatacactgaacccaatttgcagtcttttatccctcgccccctcccaccctttcccctgtgtccccaaagtccattctatcattcttatgcctttgcatcctcatagcttagctcccatttatgagtgagaacagacaatgcttggttttccattcctgagttacttcacttagaataatagtctccagttccatccacgttgctgcaaatgccattaatttgctcctttctagggctgagtagtatatatatatatatacaatttctttatccattcatttattgatgggcatttgggctggttccatatttttgcaattgcaaattgtgctgctataaacatgcgtgtgcaagtatctttttcgtaatgtgtgttttcaaaaagcaagaaaatttccctatctaaccaccatgcaattattcaagtcaggaagtttatcactgatacaagaccattatccactccatggtccatttttttttgtcattctttttttttttaagtctttgttaacctagggtaattccacagtctttcttgaccctaacactgagaattccaggccagttattttgtagaatgcccctcaatttggatgtatgtgatatttctcattaggatattcagggtacaaatttttagcaggaataagtggttgatttaaaatctcagaatagctgcttctacccacatctccctcactttgacctgacattgtgcgcaattgggaagcttttgaggttttctggtgaaatccagacttttctctgctttctcctatgatctctaatttagccatcagaattgctaaaatcctgaggagaatatttgcttcttggggagtttacactaagcagaaagcttacattaattcaaaactcattcctaatgtgtgtccccaccccaatcccccagggattagtacctgctttattattattgcaatgaataaattattcatcagggtggctaaacggcttacagagataaataacactacatgagtgtaataaagatatttcccttttctaaataagtagcacttgtaactcaacctgtaagactgtgcttctttccagagaggaagagtcctctaaatggtacctgaagagcaagagctttaaacaggccctagtgcaaaagagttcaaggcctcagtgatgcctagaattctgattgtgccaattcagtccctgctccctcactctggtatatccaaggctaccacaaagtggaaggaggaggatgtgtgggcgaagagtgggtggagaagacttccaagaattggaaactatgcagactagcagccggtagttaattagttttacttctgaaacgacccctttgtgcagcttgtccttcctgagaaagaggttaaaatgctgccatggctgctttttagcagtatagtgattaaaacaatcccagggcctaaataagatgactctacttgtttggttgaggagagagtggtcctccttcattttctttttctcccctcctactcactgaacatcacatcaaaaaatgagcaaattcctacactttacttcctattcctataggagctatttagagggaggaatgctcattaaaggagattctagaatctaaagttgcctgttttactgaaactgggaagcaaactggagatgttactagcacagctaggacacagttgataaaagtagctaacatctattgtgcatttagcatatgctgggccatcgcttaagggcttttcatggtttatctcatttaatcatcactacgatctatgagttgggtagtgttatgattatgagcatatatgtccagtttttcagatgaataagctggggctgagaaaggtgaagggactgggccaaggtgagttagaatggaggcaggatttaaccacagtagtctggcccagagcccattgctcaaccactgtgctacctgccttccagcttccatttgcctatagtctagtgggagtcataaaagaactaagagaagaagatgaatccagactggaagtggatgggctcctggctaggccaggagcctcaccagtcagagaccctggaccccctggccaagctcaccgcgggtgaagaaaaaaatccacccctgctcagcctggagcgagaaggtgaccaaggaggaaatggtggcagccaagctcagcatgaccgtcactcacagcaatgagaagcatgaccttcacgttaccctgcagcaggtccagcggtgaaccaattgcccaagacctgacccaggttgttggagaggccacaggggttccactgtcttttcagaaactcatatttaagggaacatctctgaaggaaatggagatacctttgtcagcatgtggaatacaaaatggttgccaagtcatgttaattgggaaaaagaacagtccagaggaagaggttgaactggagaaattgaaagagttggtgaagcctgtggagaagaaagctgacgaactttaagagttgaataaacagcttactggactccagcaaggttttctggccaaggatttgccagctgaagctctctgcaaacttggtaggagaggaaaagccacaaccaaacagtttatgaagatcttggaagagatcgacacactgatcctgccagaaaatttcaaagacaatagatcaaaaaagaaaggtttggtaaaaaaaaaaaaaaaaaaagtcagacgttcgtagctgagtgtggcacagtggagcagaacatctgccgggagacccagcagctgcagtctacaaacttggccctggctgagtaaggtgtggcagaaagaggctgtgctgccctgaagaacagcaccaccagctctgccctctctggagcagaatttacctgatttattctagggacaactggcctattgccaattttcctattcctagcccagttctcagtgaaaaactgttgtccttgtgatcttgagtagggcgcttgtctgttttctcattgtgtctctgtggctgtgtggtccagcagcctactttttctggagagggcctcccctgcccaggttttcccagctatttgaccttctggtgctttctttgggctggtgagatctctcctttgtcctgagctagttctaggtttataggccaccctggtcttcagatacatgagagcttttttgctcttgtgatcacacagtcccatagatgtaaaaccagaatcactaggaggttgcatttataatcaggaatgttgagaatggcttagaacaggtgttcggcacatagtagtccaagtgtccctcattgtgacttaattccagaacatcaggctgggttattggtttataggcattgttcttaccttttagtgacctgactagcctcaagacatgaaatatcagggggccattcctggaatgaagcgtatggttgatgcatggacttcctcgtccccagtaaaatcttcagaacccagtgttgactgagtccgtgcttgaaaccaggcatagcaatggcttaggcggggcaaagagggggagccacaatgaataaagcaggctggtggtgaagccaaccataaatttcccaggaatgacatgtgcttccttcaagggcatttctgttaaaaatacccttctgagatctgtatttccttcaaggccattcttgtccattttgtggattctcttgcagaatcactgttattgaaaaagtttgagcacaggtatggtggcacattcctgtagtcccagctgcttttggaggctgaggcaggaggatcgcttgagcccaggagtttgcatgtagcctgggcaacatggtgagacgccatctctaaaaaattaaaaagttaacgaataaataaataaaacagtttgaatgcccatcatcaagcagaagaatgttttctttttgttttggttagtgagaaaaaccattctgtggttctaggcataatttatgtttaacagagtagccacaacgtttaataagaagttactgtgtcttggacattgttctaagtttttaaatatgtattcaccatttaatcctcacataacctaagaagtagacaggtattagccccgttttggagatcaggaaactgagaacacttaggtaatctgctgaaggtcagacagtacatggcaaaaccagggcacaaagctgggcagtttggtttcagagccactgtttttacgctctaccgtactacctctcgaccaacatagggttacatgctcccattctctatatcctctccctatacttttgtcttccatgttagtctttccactttctctctggccctctctagttcattctccccagagcactctgagtgattataaaatacaaatcttatcatatcagtcccctgctcagaaacctccaatagctcactacttctcttaggataaaagccaaagtccttacctacaccttctcccatctcatctcgagcccctctcctgtttgctctctgctgtcagccactctggtcttctttcaggtcctcagatgcactgtgccctctcttacctgggggtctttgcacatgctgctacttctgcttggacagctcctcaccatccttcctccacccccatcccttgtgtacataactcttattcatccttcagaatgtaacccaaagtctcttccatggagacctcacctactctcttgagaccatatcaggcccccagatgtgatcctctcatggctacccataacttttctttcacagcattcaccatagtccatgatagcttattggtggaattatctggttagtatttgcctttaacactagactgcatgttccttaggttaaggagcttctttgtcttgttaacagcattatttcaagtacattgtcttgtatatagtaggacctcaataaatatttggagaacaaaacaaacaaacaaacaaggtgaacccatgccagatgactgggttgagttggtcagggaaaatttcacagaaggcagattggaactaggctgaaaagcaggctgggtttgatttaatgaagtgggctatgaagagcattccaggtgaggggaaccaaaggagctttacacgtcctgggaccagcaaactgagcagtttggctatggcagagagctcttgcagtcatttgcaggagacctttatcacacttctaatccatgagaagtagcagggtgaatgtgaagaactctcagagcccagtgactattggtgcatattagccagggcacagcggcactgcaatgacaaggcgatgggcctgccaagccctccccacttcctttgggctgccagcattcctctgagtctccatgaggtttgtttaattcagggggtggcagtaggaagccctcacacattctccaatttggctttaccatcagcaaagctattttgattccaatctggcttcttggatgcaaggaaagatgagcaattggcacccccaaaacttcaacaatgggaaagtaatagaaaattcagtttaaaaggtattaataaattatacagggtagactaagaagagtcttgaaggctggtataaggaacttggtcatacaagaattattataattctctgtgcaagtacacacacacacacacacacacacacacacaatgtttatccatagaggaaatcactgtgggacttgtttacaaattaatctcttgaaatttaatgtcatcaaattcccatcttccacaaataaatttgctgagaactttaagtcattagcaagtaagtgttttccaagaattatttgatgaccaaagaacagtttaacctacttgggagactttaataaagctttcttctacagccccattcttgacattaaaaaacataataagtaatggtttgacaaatattatgtattatttggaaatacattttctcatccttcttcacaaacattttacctcaaattacagcctttcaattggtctcataggattaggtgattttttttctcattcagatttatgtgtctatatttgtgtgctaatttgaaaattaagtacatattttaagtacagagatacgagttttcaatccaaatctgaagacaattgttaactgcttctgaacatctcttactgccaacaaccagcaaatgggaaaaactttctctagggaaacagttcccagtatattcttttttattatcaaaatactttgcacaaaaacaggaagatacagttttctccttaactaagcaaaatagttgtcccaatctctgcaaaatattcttcctatgactctgatccttccatgataaaagaaatgatagcatgcctttggtcttcctgcttcaggaagcaaaggaactgtaggaaaagaattaatttttcttctcacttttgaggtttgagacaaagttgtaactccagcttttcaaagtgcaaagaaaacaattcacacttattactatctgtgggacacaaatgtatggatttaggaggaaatagctggccagaaaaatgaaacgcattttaaacaaaatgctacacttgctgcttctcctctcttggcttctataatttagcctccatctgacccacctccattgtaattgctttggctctcttagtgttccttaaaattatcttcccttttctctaaaatgaactgcagagccatttttttaatctgcattttaaaaatttactttatttatctacttaaaacacagccttgttccagggggggtttaaggtggcttcaaaggatccataacatacaccaagaaatgaataacaaatgggacaagaatgaagcttatactaaaatgcttatacaattctactcatttactctgggtagactacaaatttgtttctaagctttctagcaggcagtctagaaaaggaaacttaattagttacatcacttacagtgtctgtaaaacaaaaacaaaccaattatccaagtgaagtgctagtattcctaatactaagaccagaacaaaatttctcttgagaggcttcataaaaaggtcagcatgtgatgtaactgccagcgttctctgtagcaaccaaatgggagatgcaatgatgaatttcacagggttcgtactgcatttctctgaaaaggtagatggcatcgcattaacttgaaaaatcaggaaaagcaattttatcatgagtttaggggtttgagggggagggatacaatatgatatattctagatactcacctctctgctctgctgggcaaaaccaaggataacagaacaatccagtacccagaatggcctcagggaaattattaaaccactaaaactgtatgcaacattttgtgaataggaaactgtatttttcctgacagacaaaatgcagttttatcagatccttaaaatacacacgtgactcacaaaagaacaatttcttaaaaactctagagttttaaaccgactgcagatcctgcgtgctactctgcaaacatttttttccctctcagcctagcattttttaaaaaaaaatttgcaaaaagaaccttttattgtttccatttggtccacggcttggtgagtacttctggatgttgagaagctcaggccgaaatcccgaagccagaagaatgcagaggggcacctcaaaggttgctgggctctggaagctcccagtcgtccttgagccttctgaagagatactccaccagcccggcctggcggctggccagcctgcagaggttggtcaagtagttgcccatcttcttgatgagtttcacctctcggtctaggaagtgcttttccagaaaatcacagaaattgggatctgtgttggcagaacctagggcatgcagatccaaaaaggcctggttcaggctcttctccagggccagggcggcttccatggcggccaggctgccactccactcatctcagagcagcttctgctcatcttggaagaggccgcagctgctgggctggttctgcatcaaaagatgcttggcaccctcgcatttctcttcagccagcttgcgaaagaagtggcccacgcccttgagagccacttcgtcgccttcgaaatagctcagagagaggttggtgtaggaggcctgcagatgcatgttgatcaggcggtcaatagcggcctccacgccagaggtatacttttggcggctccgggtgctcatggttggttggcgggcaaccaggagctaaccacaaaagcttgttagctggtcccagaagcgagagataattgagcagatagtcacggaagttgtgagtggagaggcagggttagagggtggggagaggcagcatggggagaggcagattggggaaggtggggagaggcggggtggggaaggtggggagaggcggggtggggagggtggggagaggcggggtggggagggtggggagaggtggggtggggagggtggggaaaagccgggtggggagggtgggaagaggcagagtgcggagggtggggagaggggggtggggacggtggggcttggtggggttgggcgggatcacagggcacagaatctctcagcctagcttttctttttttttttttttcttgcatgtaagatttattttgatgatatcattcagccaggaccctggtttattagtaacattgtacatattcaaatttcttaaagaaatttaattttttaaatagattaaggggctacaaatgtgcttttgttacatgggtatattgcatagtggttaagtctgggattttaggatacccatcacctggatagtgaactttgttcccaataggtaatttttcaaccctcaccaccctcctttcccacttgggagttccaagtgtctattgtttcgctctatatgtccatgtgtatccattgtttagcttccacttataagtgagaacatgtggtatttgattttctatctctgagttactcaggataattgtctctagggccatccatgttgctgggaaagacatgatttctttttatgtctatgtggtattccatggtgtagatatatcacattttctttttctaaccatccattgatggacacttaggttgattccatgactttgctattgtgaataatgctgtgataaacataggagtgcaggtgtttttttgatatcacaatttatttttctttgggtagacacctagtaatggaattgctggatcttagtagttctatttttagcttttcagaaatctccaatctgttttccatagatgttgtactaatttacatgtccacaaacagtgtatgagagttcccttttctctgcatcctctctaacatctctcgtttttctgactttttagtaatagccattctgactggtgtgcgagggcatctcaacgtggtttaaatttgcattgctctgatgataagtgatgttgagcattttcatatatttgttggctgcttgtatgttttttattgagaaatatctgttcatattatttgcccacttttaatggggttatttggttcttttctttttgaatttttggagttccatgtacattctgggtattagtcctttgttggaagcatagttcacaaatatatttctctcattctgcaggttgcctgtttactccattgattattttttgctgtgcagaagcattttagtttaattaaattccatttttctatttttgtttttgctgcatttgcttttgaggtcttagtcataaattcttcgacttgggcaatatccagaagagtttttcctagattttcttgcaggatttttatagtttcaggtcttacatctaagtgtttaatccatcttgagttaatttttgtatatggtgagagatatgggtccagtttcattcttctacatatggctatccaatttttccagcaccatgtattgaatatagtgtcctttccctagtgtatatttttgtcgacctggcaaagatcagttgattgtaggtatgtggctttatttctgggttctcaattctgtttcattgatctgtgtgtctatttttgtaccagtatcatgctgttttggttactatagtcttgtagtataattagaagtcaggtaatatgatacctatagctttgttctttttgcttgactgctttggctgtttgggctcttttttttttttggttccatgtaaattttaggattgcttttttctaattctttgaaaaatgacactgataatttgataggggatacattaaatctgtatattgctttgagtagtatggtcattttaacagtatggatttttccattccatgagcacgtgtttttctattttttgtgtttgacttctatgatttcttttaccggtgttttatagttctccttgtagcttttgataacaatttaattcctctttctttcctaattgttagaaaggagtctttatttgtcatttggctcattttttaccataattctaagatgaggtaagaacatcaaaagtactcatagtgaaatccctctaaatcttcatttgtgagttaaaactcccttgtttttaaatttagaggcttatgtacatatttttttcctgctcctaatccctcattgggagtgaccattagttacagtttgtccaaagtggtcctgttgtcttggtataatgattaatagcacccctttccctctcaaaagggtccttgtttggaatatatattacatggtcaccttacccattgagaaggaaaagaaaacctatactatgaatagagtttgtaaaacattgaacttgaccatgatttgtttccattttattacttaatcataccagtaagaaccctatcataaattttctattcatcactttatattttttattcattgacctaattatttcttctagaaagttctattgaatggcatatgtaccaggtgttttgttaggtactggtggcttcttagggttcaggaccttgctccattaactgaaacatcatgtgaatgagtgcaaaagacaaaaaatacagatttataaatcctaccaaaatagaaaataatccatataagttgaatgagttggccatttcctgttggaagatgttctcacagggtatcctccggctttgtgagtccatgcttagtattttattttcctaaataccactttcctggtgctgtttcacaattagaacacttttgtatgttttctaacaaacaagaaggcatattctattcagggtaaacaagatttgaaccccagagaagagagttttgctttgaactttggacttcggactaaataaaaataaaaattcatttttttcagcagctttcaatttgtattttctctgttgctgaaaactgacatcttaaaatttcaaaaagaagcctggagtcttcctttactgcttaaggtaaaatatgaacacatatcctttatctaaatacaggatatattgtcatttttaatttcatggatggttgtagtccaaaagtattctcatattgcatttgaaatttgcaaaaactgttaatattcagaaatagtcacatttttcaatcttggggggaattaactggataaaacatgagtgcatagttctgcagtcttcctggccttggttctagggcagaaaagaggctggcagtgtagaggaggaggaaaaacaaaaattcaaacccaagaacaaccctagcaggtaactaaataagagataaattaaaccagatgcaatgctctccaaatgactgcaaagaaaatgattgttttctaccttgtacataaacaattaatcatcatattgaccttataataaggaaatgctaagcttagagaaaacttcaccatataaaatattacctgcattgcagcatgtcagggtcatttaatatatttcaatttcctatacatttacttattcctcttggaagagaataatgtctatataaacctttccagatgagatagttttctgccttgtgcaaatgttgacaaatctttccgtcattactttagaaaaaaaaaagagccaatatcagagccatactctggaggtagttaagcacacagccgttagaatcagaccaaggtaggctcaaaacccagcttcgtcactgtgagtgtgaacttaggcaggtaatataacttctattagcctcagctttcttgcttataaaatggagatgttaatatctcacaagtatgctacaaaggttaagtgataaaatgcacaagaaaatgctgccaaacaagtagaaagaactcaaaaaatggtgctatatgatcgatcagttttggaataaaatttcagagatcctctcaaaccccagtaagtatcagaagcagatcccaatatgtttttgatccaagttttctcactgctagacctcttttgctgaatcaccctctgtgggtggctacaccctttcaagcacgaaagcacataggtacagctttgagtgttcaagatcaaggcatttagaacacaagcaaaggcagctcctcttacttcccttggctgagcaagcatcaacaatgcctcccgaggcattgatcgttgtggaagcaggaggagcagtgcaaaggtggcagaagtatgttttctcagttctccagaccaagataattatccattacagaaaaaaaaaaaaaaaaaagaatgagtgcctattttgtaggatagggtaagattctgaaacattacacgtgagtggtaaaattcaccttccctttcactcaaatataaaccttgggatgccttgagaatctttgatcagattccccagaagtagtccctgatatgaggattcctgtgcaagtgatttatggggaaggtgctcccacagggagaccaaaacaaagtggggaaagcaggacagagaaagaagccaataaacaaagcttcaatgtcaggaaatatcacagcttagtcatgatctcaaggtggagctctggggtgcaaatcacacctagagtttatttcaacatgagacaagggaactgggcttttatattcttgcccaatggtcgtgggcctccccagggtaataaaaaactcccagggtacatgggaggtatgtacaagtgaagcaactccattagtccaagagaaagccgccaaagaaggtcacaggtgctagtaactagcagaaaagcaccctgaaattgggtgctgagcatatcaaacagggagaagggaatttgggtagggcgtgtacagtatccagcaccagcttgctaccctgcttgaccttggaaggtatcagaattcagtggtaatgaggaaccccaatcagaacctttttttttttaaccaggaatctaatagataagatgaagactgtcttataggtattaacctatatttattcttccttgctacttccatttacagggaatacagcggttttggaacctacatctgtagtctcctttaccatccctgaaactccgtcactctcatcaggggtcctcatttgtaaacataccagccaaatcaggtccaaagctctagctaagaaagcattgcatcttttttctgaccctctactccgtttgacagcattccccatattggaaccacatattgatttttttaaatagcttcacacaactacttaaaagtcaaaatatccctggcaaccgaaaaactgacaggccgtgaaatagctgcttaaggacctgtcatccaaactgaactcacctgaaaactgaaaactgattttacacaaacagtaaaatggtttctgtgtatttgtcatttttctaaaagagactgtaaggggtactgagtttagttctgagctgttctgctttagacaagggaccaccttgcaccaggcagttatgaaataagagttgtttcattttcttctcccaaaacacacacactcagtctcctcctcaccccacctgtgccctccactaaaatcactgagaagcttgcccatggcccaccctaacaggtttgcttccccaaatcctaccttccctgtgcttcccacaggtacctcaagcaagcagcacttctcaactggggctgattttgtcccctggaagacatttggcaatatctgaagatatttttggttgtcacagctggggagagggcacaactggtatctactgtgtagagaagcatttttggcctctacatcagttttttaaaaatcagtatttaaggggagacactgttctgtgcactgtctctcccccgcatcagacaaacaaatacatctgtatatgtacaaatgtaaatagcttcacacaagtacttagaagtcaaaatatccctcgcaacccaaactgatgttacacaaacagtaaaatggtttatgtgtatttgtcattttgtacatctccagccccaaatgaatgtcaatagtgctgaggttgagaaaccctgtatatgttggtgtcttagtgtaggtttcgtcaaaaacagaccctgagacaaggatttgagtgcaactagtttatttagaaggtgatccctggaagcactagtagggaagagggtaaatgagagagtgaagggataaacaaaataataataaaatgagagagtgagggggtaacagcaagttacccctatggggacctaggactcattcctgctgaggaactctgggagattgtgtggaacatgccttagagttatcccaaacaaggccatggaagctggaatagttatcttctaattcccctctgtcattagctgaggactacttccaaagatgttaactttctggcacttccggcctgcccttgaagaaccaaaagcaagccctgagatagagagttgtaggtgtttgcagaagaaccttcatgggcatatatgggcatggtgagtgctgaggggttatgaatgccataccaacaatgtctgctggagttggtcctccaagagaacatgtatggggatttatcttcagtttctttttctgaggatgatgccttagccaaaaataaaattctaatcatgcccccagtaggtgtcttgaagacaagcaagagtggcatgttttagagggaccttgttagaacatgcagttagaaaggcccttagaaaccatgtgttccagctctataccaatgcacaaatcccttgaagaacatccccaacaaataaccatctagtcttttcttgaatgcactgaggtacccaggaacacgttaactcaggaagctcacccataccatttttagagggtgtgatgtaggggagccaaacaaatgtgaatttaaacttggttctgccacttaacggctatgcaaccttgtgcaagttactgaacttttttgaatcttactctccttagctataaaataccagcaatattatctacctcttaagattactatgaagattaaataagataatacaaggaatttagctcaacttctgacacatagtaggtgctcaataaatattagctgtcttcacccctttttcttctccaccttcccaaatctcatgtgtcagctctgtacctcataatacttttgatcttttcatttcggttctagcttccagaagaataaaaaataagtccagcccatctttccactaaactaagacttcccccttctccacggaagcatacctggcttactccaccattccttacatggcctggctctgtgggcctctattctctggtctctccccagaaggttttagaatcccctcaaggagacagctgcaatctcatcctgacctgaggcaaaatacacttgtagatcacgtccatttaattttgatgcacatagatcaaaatgagttttgtatgaatagtcttctcttttaacataaagaaaaatctaaaatatggtttaaacttcttatagtcagaaaagagggcaggaagtgattctctctttctttaccatgctctattttaactcttgaaaatgtttcttccatgctgtatttgcctctctccctccatgatgaacagtgctttctgttacttttttcaaaggaaaaatgtaatgtttcatagaaagaaacaagattcatatcctgaatagaggtggcctcatatctcagaagagctggcaagtctgtccttggcagttgccaagaggtgggttggacagatacagcttgagctggaaacaacatccagccttgaaatttgaagtggcaaatttgcaatgccactctctctttccctgcttgaagcccccgattgtactttctggtcatactgaaatctggttggaaaaggaaatcacctgacaggagattttgcttttccttactatagcatgatccaatttttaaaaatgtatgtgtgtgtgtataagtgtatatatatatatatatatatatatatgtatatatgtgtatatatatgtatatatatctgtgtgtgtatatatatatatgatgtgtgtgtgtgtctgtgtgtgtgtataaagatgtgtatactaaaatattaacagtcgtctctatctgtgtgtgaccaagtgtttactttctacttttctgtattatctgattttgggggcaataagcatgtatttaacattgctgcaggaaatcagggggaaaaagacctgtttctattttcaaagaaaagggggaaacttgctgtcctttctcaagtaggtcatatgatttttgcccacaaagcaatgaacagggctcagtgtttgtctcctgaagccagagctagcttgctgaaaggcatcctttagcctcatgggcaccaagctattttgcatgaaaaaattaaaattcaggaacatagagggctttctcatccattcttcctcccttactcctctgggacttcactggcaacccttctactccctaccagccaccaacaacttgaggttcagtctgaggactgagaagaaaagagaatccctcctgggactgagttggcctctaggacaggaatgttgctttatacttcttccatattccctgctgggtctggcaccatgattgacagaaaaaataactgatgctcagagtaatggaacctcaaaggtcatcagtgcttaataatttcctaatgaacagattaaatgtggctactggtcactttacctgcttaagaggtttaagccacagagtcaggtgcctcaattcatccagagaccatccccagccagttcccattctcagtgtcaaggaatacaaagacatgactgagcatttatgcctctatgagtgggacaggagaaggggccatgacccatggtgggactagcaccaacaggtctgttttacagcattcagggctgatgatagctgcatgcctggcattcatacaaatctgccctcccacagtgttcttgccccttccttggggtgtatggacatggctgccggccaaaacacagctctgttcaccaattcaagataaggaaatatctatctgggcctgactttctatataagtaccagatggtaatgattaaaattaatttaaattaatgtttgacagtccatgaagggcataaattgcatagtgtgctgcttgtccaatctgtcatcttgtttccctcggctcaggtcaacaaacaacagctgaaagcgccatctctgagtcaaacagtagcttatttctctgctgtggaaatggctgctcagtttactaagttgaaggcttccatgctgccaaaattgtgattaagatgccttaaaaggcagagaattctatctttttgccacaatctccagcaatcatctcccaaacacagtaatagcaattactggttagagttcagaaactgggaaatctgaacctggcctaagagtgaaacattgccaaaatcacaatgcaattttcagctctaatgacagccttcttcattcacatggtttctagaatgtgtgggcagtgctgatgtgttatcaagttgcaaaagaattcatggcatcacattttaaaatcatccatctgccaagtactcccttcctaaaaacttttcagatttagatttttgctcctttcccctgtgttgttcaggaatcagtgtccaatatttactttttagtacttaaaccccaaataacgtttcaacttttgcccttttacacaagaactttgatgaaattttcaaaatgtccagcataacttctttggtgggaaagattggattcttcaggagcaagccaaatagtagaacaagctactgaagacaggcacagggtgctggaagttgtaccacccagattgcccttcaggaatgaaacacttctttccccagctgctaggagagctgcaggggtatggccatccactgtcagctccctttggagattgcctccactgaagaaaactgccctacccaagatttcttctccttctaaaggcagcccacatcactcaacttggggcaactctgaagggccatccctgcctttctggttattttctctacccgggcttgtctcccagattactgcctgaattcctcccaacttcattcaggtctctgctcaaatgttgcctcatcagaaaggctttttcctcatctctttttttaaaataacacacactcagccctttcccatagccccagctccagggctccctgtgctcttaccctgccttcatttctcttaccactacctgccattatttacacatttatcaattattttgtttagtgcctgtctccccactagcatataagctatatgatggttgagaatttggctgttttgttcattgctttatctctactacccagaaaaatgcttagcacatatgtagagattctcgataaatatttgtgaatgagtacatgaatgagtgattagttgcctactatcttaggtacttcctactgcttaggctgcctagctctctcactgcacatcctgggaatcagagtcctgccaaggtagcataatagtcaagaacataggctatggagttcgactggcctattcacttagttcataaacaattatatagttcttaagttgtgctaggcattgctcttggctcttatgctattaatacatttaatgtgcataacagccgtaagaggtaggtgttattcccattttaaaggtgaagaaactgaggaacagaggcgttaagtaatttgctccatgtcatacatctagtaagcgacagaattcaaatgcaggcagtctgcctccagaatctctgccacttaccagctgtataattttgagtaatctcctctctgaactggtttatttgcccatacacatgaaaataataatacatactacacaaaattgtaagcagttttaaatgagatggtatgtgtaaaatacttagcagggatccttatctacacaagcacttaacaaggggcagttgctatcatttgtatcccagtgctttgccttcccctacatcccaatagactgcatggacttccaactattaccccatgtttcatattagatgccctgtcttgactgcttgacactttctgaaggccttgaatggcaaacccacccaccattctgatgttccatgcacaacccagccttgtgtcacctccactcttgactccaatctagctttgccctaccgctgtagacagagctggggccaggtcaagaactcttcaagtctgccgttccctgtcaggtcttgaaataaaatgtatcttagaggcataagcaacaaaattcaagtgacatgacttgcctttgataactagcgctgcagttcctagttcccattacccagcataatcactcagataagccacagcccaaattttaccaggtgttctggccactctggtgcactgtccagatccctcttcaatgaggttcttgttgtctccggtgctaggagcactgatggcagacagcccttagctctaagcttcttcagggattgcctcagctgaagtgaaccactgtgaccaagaggtagtttccttgataaccttctggggttgtccatatccaatgacctaccaatgcaggaatagaaattcccagccaccttgctgctgggataattggcaagccacatgtaggagaatgaaactggatcctcgtctctcaccttatacaaaaatcaactcaagatagatcaaggacttagatctgagacctgaaactataaaaattctggaagataacattataaaaacccttctagacattggtttaggcaagtatttcatgaccaagaacccaaaagcaaatgcaataaaaacaaagataaatagctgggacttaattaaactaaagagctttttcatggcaaaagaaaaagtcagcaaagtaaacagagaatgcacagagcggtagaaaatcttcaccatctatacatctgacaaaggactaatatctagaatctacaatgaactcaaacaaattagcaagaataaaacaaaaaatcccatcaaaaagtgggctaaggacatgaatagagagttctccacagaagatatacacatggtcaacaaacatgaaaaaatgctcaacatcactaataatcagggaaatgcaaatcaaaatcaccatgcaataccaccttactcctgcaagaatggccataatcaaaaaatcaaaaaatattagatgttgatgtggatgtggtgaaaagggaagacttctacactgctggtgggaatgtaaactagtacaatcactatggaaaacagtgtggagattccttaactaaaaatagaactaccattcgatccagtgatcccactattgggtatctacccaggggaaaattagtcattttcggaaaaagacacttgcacacgcatgtttacagcagcacaatttgcaattgcaaaaatgtggaaccagcccaaatgcccatcaatcaacgagtggataaagaaaattatatatatatatatatatatatatatatatatatatatatatatgatggaatactactcagccatgaaatggaatgaattaatggcattttcagcaacctggatgggattggagactattattctaagtgaagtaactgaggaatggaaaaccaaacattgcatgttctcactcataagtgggagctaagctgcgaggatacaaaggcaaaagaatgacacaatggactttggggacttagggggaaagagtgggaagggagtgaggaataaaaggccagaaattggagggctgggcgcaggggctcacgcctgtaatcccaacactttgggagaccgaggtgggcagatcacttaaggtcaggagttcgagaccaccctggccaacacggtgaaacccaatctctactaaaaatacaaaaattagccaggtgtggctggtggcaagctacctgggaggctgaggcaggagaattgcttgaacccaggaggcggaggttgcagtgagctgagatcatgccactgcactccagcctgggtgacagagcaagactcagtctcaaaaaaaaaaaaaaaaaaagactacaaagtgggttcagtgtatactgctcaggtgatgggtgcaccaaaatctcagagatcaccactaaaggacttactcatgtaaccaaataccacctgttccccaaaaacctatagaaataaaaaattaaaaaaaaaattcccagccaccttggcccaactgagggcaattctgaaaggccattttaacttcagagctaccttgggggtctgcctaggctgttgttgggcctgcatcacagtttatcttctccctctacctgcttctgcttttttcccctcctttccccagatattggtcccaagggtgcaccctaatgaacatcctgtctcctatgctccatctcagagtggacttcccagaataaaagcctagcctataacacgtggtccagcccaattcactgacacttgttgcaaggtcgcaggattcctctagaaactactaagcccaggtgacaaaatggcttcccaggattatgactccctggttgcttccccaattcatcctgtcattttttaccccttctcagaggcatgactagtctagcctagctgcttacacaaagcagccagaaaaaaatgatgcctattaatcagttcttgcctcctgctgatcacctcagctcagggcttctctttcctcaaggaagtaagacagatgatcatgggttgccacaaaatgctggttctttactttgacctcctcagtcctgggaggatttatcagccaacaacaagctcatttaactacacgtcagaagcagacgaagagtcactcattaagtgactataaacaactaggtgcttcacacgtttggtaaaggcccatatatttataaatatgcctttgggcatatttatatgcccaaagcctcagtgatactcactttgggaataacaaatcccaaaccacttatttgttatgaaaataaatgacattttgatctcagtaatcatttaaaattctgtccttttaatggcccataaaatcttaacatactcccttgcatgtcagatttcctaaactacagctggatcaacctcataacttccacttggtcatcaagaatagataaaatggctgggcgcagcagctcacacctgtaatcccaacactttgggaggccgaggtgggcggatcacctgaggtcaggagtttgagaccagcctggccaacatggtgaaaccccatctctactaaaaatacaaaaaaaaaaaaattagctgggcgtggtggtgggcacctgtaatcccagctactagggaagctgaggcaagagaattgtttgaacccgggaggcggagtttgcagtgagcaaacatggtgccactgccctccagcctgggcaacagagtgggactccatctcaaaataaataaataaataaataaataaataaataaataaataattgccttatttaagtgtgcagtactgtgtgctggataaactaataaaatcttagaagataaaaatgcagcagagcataactgcttatttttcagatttactaaggaaagatactttatctaattaagtagatcttcttaagcaaatcctttgctgtcacagcatgtagcctagttcttataaaggaatgaaaggaacacttgatagtctattggtttctcatattcgttttagtttttttaatgtacttttagaaatactgtttcatttctgatcttagattgtctggctacccaaattggagctggtattgttaggcaggcctgagtcctgatcaatattccattctttatagtgaaagatgatataattgatgcggatcccaatctgaatggacaatcacagctgtgaaaacagatgctagactcccaggcccatcccagccatacatttctattcatggtgcagggcacttggcagagatgggcattttgtgtcagtaagcctctgatacccctgggctgtctgaagattatttttaaaaagttatgattcactgctgatagggctagctgcctcctaggattctacaactcctatggcacctgtttgagagttttcatctgtgcttcagatacctacagtcacctcatttcaggccccctatgttacttggatcacaggaacaatgaatcgataagggcttcattaaaatattctgtataaaacattttatggttgtgaacatcacaataggggaaattaccgcagtttaacatctgcccataggagcttcagacttagttgaggaaacacaattaaagcagaataacgtttgccatcattgaaataggttgtatgaccacctccataatctcaaagtgaatcacaggggtccttgttaaaatgcagctctcatagcccatctactgaataagaatctctggattggtgatggaatctgcatctttaacaagctccctaagtaattctcatgcacacttaatgttcaaaatcattaccctagaggctgattatttcagcgcaggcatggttcctgcaatgccacaactagttagtgattctctctgtgttttggaaggaaatagcagcattcagtgacgatcaccactgaaatgtgtgattagtcattataatgatggtgttgatgcctcacccagagcatccatccccagctgcttacaccatcttacccagcactgtgactagctctatttattttatatttagtagctatgagtgttggctgctaacagctcacagctgcactgttctcttgagaattactctcagctgatgggaacttcacccagagatgcctaagaggttatgtacccaccagcacagtcaatgacaaactggtatgtaggagcaaaaatccagtccctttgcctccaaggagacaactgtgtggtgccgtctttgctctagaacttcctgtgggatcaggctgatgctagacctctgctgaaaccatatctttgcttagcctcttcccctgcctttcctgcttccctcacttccttccttacaggtttctcctgagaacatttcaaaaaataagtgttggagaggatgtggagaaagacgttcacttacacactgttggtggaaaaataaattggtatagctattatggaaaacagtatggaggtttctctgaaaactacaaatatagaactaccatatgatccagcaatcccacttctgggtagacatccaaaggaaatgaaatcagcacattaaagagatcctgcatgcacatgttcattgcagcattattcacaatatccaaggtatggaaccaacctaagtgtccatcagtggatgaatagataaatacacacacacacacacacacacacacacacacacacaaacacacacaatggaatactattcagacttgaaaaagaagatcttgccttttgtgacaacgtggacatggatgaatatggagaacatcatgctaagtgaaataagccaggcatagaaagaaaaatactgtgtgatctcacttgcatatggaatcttaaaaaagtcaaatcctgttcatagaaacaaagagtagaacagtggttaccagggcataggagggtgggaaatagggagatgtcggtcaaggatacaaagatgtagttttgtaggattaataagtctcgagatctaatgtacagcatgaagactatacttaatattgtataatggaaatttgttaagaaagtagattttaggtgctcttaccattaaaaaaatggtaactgtgagataatggatatgttgacttgatagatatattaaccatttcattatgtgtatttatagcaaaacatcgtgttttagaggctttttctagggggaatgtgttataaaaataacaaaagtaactgtgataaatacagagatatatttgtagcaggatataaaagaaataggaggttctggttccatgtaaaatgggggtaactccaccctgtttctcccactcaatgcagctacaaaacctggacagaatgcacggggcagctatttgaggactccaaaaattaaacagtagtgggcagactaggagagaagacaggccagaatctgaagtactaccaaattgacactgagtttatcacttatttttcttctgttgtccccgacctagaatcaaggcatcctgaaacatagaaatgggtactcaggcaccgacagaaaagctctctaattctgtcttgaagagcaagaaagagatctcctgatgctcagagagagggtggttgggggaagttctctgagatgtttcccttttctctgtgcttctgcactccaggacatcctgcagtaactacagtagcagtagagacagcagcagcactgggggcctacggatgcctaaaattctgagggaggagaaccactgtttctgatcaggatagttatgttccaaaagggtggggtgaatccccattgccttttttctttctatctgccctcctgctgtttcagttcaggactgacataggttcagttgttggaagtgcacagcacagcatagttatataaagccccatctttcttagactgtaagagggtcacagcctgtaagttgagccccagggaagaaaaagtaatggggacattttggaaagtatgaggaaaacaaccccataaaattgtgaagtcctaggctccctccctagttatgcatgtatggatctcacacaaaacaatataccaaagattttgagaatgaaattatgggacaggacactgcttaggttctaaattggctgtgggtttcacgcatatgagacagacctgaatagcactgcaaaagctttggaaactgaactgacattggaaccacaattcaaagaaggctggttggaatgtacagcctgaacccaatcaagttgattgcctatcacagcaaaatgaactacattccctacaggatgaaagacacagagtctcataacctagagtcttccaaaatgtccaggataaaatccaaaattactcagcatagagagaaccacaaaaaaagctcaactctcatgggaaaaacaaccaacagaaacaaacgccaagatgacacagacactggaattatcagagactttaaagcactaataattaaagagtataattggtttgtttgtaacaaaaagaaaggataaatgcttgaggtgatggataccccatttacccagatagaattgttacacattgtatgcctgtatcaaaatatctcatgtaccctataaatatatatacctactgtgtacccacaaacattttttaaaaatttaaaaagaagagaaaatactctcaaaataaatgagaagacagaaagtctcagcaaagaaataaaggatataaagaggaataaaatgaaaaatttagaaatgaaaaatacaatgatcaaaataaaaactcacaagatgggctcaatacaaaaacagagataacagaggaaatagtgaacttgttgggagatcaatagaaatgatcctatccaaataatagagacgaaaaaatatttttataaataacaaacagagcctcagggtcctgtaggacaatactaaaagagctaacatttgtgtcattggagcctcaaaagaaaatgagaaagaatatgctgcagaaaaaatacgtaagaaagtaatggctgaaaacctcccaaatttggcaaaagacataaacctacagacttcagaagctcagcaaatttcaaataggataaccctgaaaaaaatctgtgcctagaaacaccataatcaaacatctgaaaactaaagacaaagaaaaaatcttgagagccaccagagaaaatgacacatgacttacatgataataacaatttgaatatcagcaaatttctcatcagaaaccatggaaaccagaaggaagtgaaatgccttttttttgaagtgctgaaagaaaagaattgtcaatccagtccttcagtaatgagggtaaaataaagacattatcagattaactaaaaccaagaaaatttattgccaggagatgttttctgaaagaattgttaaagaaaattcttcagacagatgggaaatgtcaccagagagaaagttgcaacatcaggaatgaaagaaaagcaatagaaatggtagacatctgggtaaatggaatattatttcctcttgagttctttaaaatatgcctgatgattgaaagccaaacataacattttgtgatagggttttcaatatatgtagaggtactacataaaaggcatttacagtataaagggggtaggggaaagggacctatatggtggtaatttttttcacttgaaatagtaaaatatcgatttagagtagactcagaaaagttcagtgcatatattataatccctagaaaaaacacaaaaaaatagtgtttgtagtgttttccttttctctgatcagtaaaaaacaaacacaataaaagtaaaaataaataaataaaaaggcagtaaaaatacaatagacaaattaaaatggaatattaaaatatgtccaaataatccaaaaagggaagaaaaagaaaaacaaagaaatgaaaaatagaacaatcacaaaataaataataaaatagtaagtataaatctaaacatatcaataatcacattaaatggaaacgtaaaagtcaaaaattgtcagaatggatttttttgaaaaagacccaattatacactgtctataagagactgacttcaaatataatgatataggtatgttaaagggatgaaaaaagatatattaataccatgccaatactaataaaaacaaagctggagtgactatatttaaagaacagatactggcaaagtggcatgctgctgaatctaagctacatgtcaccaataattacttaataactcttttatttacattctttcccagaaaagttttacctcatctcacttatagaccttccagacatccagatactaaaaagcttcctagcactagctagacaattttttgtgaaatgttcacaggttttgaattagaatcttccagactattctatctaatggcttaccttaagaacataagacataacatccttctcaactctgttaggtgagcgacagttttccaggtagatttctgtttcctataaaaaaaaatgttattttctcattttcattttacaatgataattacacctacctgatatggctgtacatactaaaatgagataccttatgatacatgtttagcacagtgcttgccacatagtgggtacacaatgaacatagtttcattcctcttcatttgcatgccttagagttatgtttgctaagtaaattgagagtaaggtctgaagtctcagataaggttttataatgggtatgtaatgatcttggcctcgaggagaagccaaggattggatggaaagtaaaaaagaagaaagacctcccaggcaggccctagtaataagatagcatgaaggtaatctttgaagtcccaggcagccaaaggtaggattaatgagtaaagaacacttgacaagtagtagggatattgatttggaatgtagccttaaggaaacacaatgaaaaaagtcttacatttgtggatttgagttgacttcaggctagcccatggccacatggagaaatacgcaatatttttctttggtgcttttccattacttatttttgctgtcatttctatcctttcagcatctctttcaaggactctagtgtactacttatgctcacttatttgggaggaaagtgggatgaaaaatatctaatttatactaaggagtttttgacctaatggattaacccttctaaatcatcatcagtttaaaagagaaccttggtttgccttgtgattaatcaagagaaaagactcttcagtgattcaatttccagcacttctaagtaaggaagattttttttttatcagaaaggctatcaactcaaatcataacaaaaagaaaactacccacttcatttatgggtgggaagaacccaaatttatagatctagacatgcacagtccagatataatcatgctttagtgtcaacattttaaatgaggctttggaagactttgcctcaattcctcctatacaggtgttactgctgagcaatagggagaagcacttcagggattcctggctgatacaaagaaatggagaagtaggcaaatgaggaaagtcaacacccaagataacagtaccgtattaaattcaaagggccagaggcatgattgccaaccatccttcatgtttgaacttaggagaagatgaagttcaaactaagaaattgttaggagcaactgttaagtccaaggtggttatggtgaccagtccatccatgacatctgcagcttatgtttcctcagtgactgccagttgtaactagcttcaaaggttaaaaaaagagcaagtgtagcaaatgcagcaatagacttctgatgctatagggaaagtttaaataaatattagagcagaattggtagctattagaacactgaagttatgaagctagtagaatacagaagttatgacacatgctaccacaggaggtagtaaaatcactatttaaagactcattagacactcatttttaagacaggatttaagaaaaataatgagatctatcttgtggtagtcctgagatatgagctaaataacccacgagaggtcccttcaaatccaagcaattctgtttaaacgttaaaacccatctgctagaatggaaattaaatccgataagcattttccttagaaaaacattgctttgtatgagcaatggtctgtttgctcttctctttctctcttttcatcccttccaaattaaaaactggctcaaacctatctcaaaagtaattttcttgatattaacccctaacaataggattcatatcataatataccaagaatgtccaataggctacatcttgataaaggattcctgaactttgtattgggaaatattctgaagctgcatttagagagctatggcttattagcaatgcctgccctgtgcaggaagggggattagagcatgcttaccaggtgtttgttactctgcctatataacaaacaacccaaggagtattgataattaaaagcaataaacagtcaatctaatattttaatattctgaggcatatatgatctcatgggcatcaatgagatttgatgcatggtataatggactccttctgagaatatggaaataagaggctagtcattgtttaaaacaaagagattcaatagaagaggaaaagatgtaacactggtacactaggaatagataaaccttttttgcaagtctactattctaaggttggaaccctaaggaaaacgtttaggtataatttaaaggagaaaggaaacagaactcatattgctattgccatatactacactgcacggcctaatggaggacacatggtattcttctaatattgattacaaaactgattttaaaggcatagatagagctgaacttgaatcatcatccatttgaaaagccatgccattaaccacaaagctatactgcctaaaccttagctgggactctgacctctcaatgcttaataacttttatttcttttgatagcctggtctacacagatatctaaaggccttcaaggttcacaaggtaaatcttgctgataaaatcacattggtttcctgaaaaagtttttcaggggattcaacccagaatgtctcaagcctggagtcagcaacgatatcttcgctcttccatttaaagttgtgaagatctattttgtggttctggtggttgtggtaatgtggaagaccctagtagagcacactcctccagcctcctatctgctttatctgagacaagtcaagtgtgtgtggcagttggggatgaagtgaggagagttgaggggatgttgcctgacatgttgttggaactcaaaaatttatcaaaagaataaatagttgaatgaatgagtggaagtattgagaccaccttaaatagtggaaagaaacgtgcctgctggccgtagaacaatagacatgacaagccagaaaaacagaagcaggctagtgtagataagattagtactttcctactttactatcagcaaccatcctcctaagaccagaaaactgggacagttttgcttaggaggcatgtatgtctgtgggataatgccaagacagaaaggctaacccttcaaattagtagagggcagtttatgtgggcatgatgacatttggcagcacttaatttcggcattctctagcatgtacagcatggaataagagggtcatatagaagaccatttaagtgtacagtttgttctaactgtgaatctgggcttggacaaatagactttcttctttttaataatacactggtatgtttggagataaacaacatctaaaacttatgaacctttaacaattttattggaggaaacaattgtggttagttttagtgatcaaagaaaaacttgaaatcattttggaataagaaattgattttgtttttaattggctattttctgaatttctcattttggattttaagctgtgctgctgttcttttaaagaaagaaagtgcttgatggtgtttgaacatctaagtaaattagggtataaggctgtatgaatttgggtatgtttaagcttcattttaaaagtggctgtgcaaaaacaaaaattgacaaatgggacttaattaaactaaacagcttctgcacagcaaaagaaactatgaacagagcaaacagacaacatacagaataagagaaaatatttgcaaactatgcatctaacaaaggtctaatatcctcaacctataaggaacttaaatttaaaagcaaaaaacaaccccattcaaaagtgggcaaaggacataaacaggcccttctgaaaagaagacatacacgtggccaacaaacatattttaaaaatgcttaatgtcactaatcattagagaaatgcaaatcaaaaccacaatgggataccatctcacaccagtcagaatggctattattaaaaagtcaaaaaagaacagactgctgaggttgtggaggaaagagaatgcttatacactgctagtcggaatgtaagttagttcaattgttgtggaaagcagtttggcaatttctcaaaggatgtagaactaccatttcacccagcaatcccattattgggtatatacccagaggaatataaattgttctaccataaagtcacatgcacacatatattcattgcagcactatctacaatagcaaatacagggaatcaacctaaatgctcatcaatggtacactggataaagaaaatgtacatatacaccatggaatactatgcagccataaaaaagaatcaggtcatgtcctttgtagcaacatggatggagctgaaggccattatcctaagcgaactaatacaggaacagaaaaccaaataccacatgttctcatttataaatgggatctaaacaatgagcacatatggtcacaaagaagggaacattagacaccagagcctacttgagggtggagggtaggaggaggataagaataaaaaaactacctattgggtactatgcttattacctgggtgatgaaataatctgtaccctaaaccccagcaataagcaatatacctatataacaaacctgcatatgcacccctgaacctaaaagttaaaaaaaataaatgaattagtaaaagaaagtggctgcacagaggatatacagtcttgggaatgactggtgtctagaatctgctaccagaataagttttgcctcggtgaatactgattttgctttgcatttatttagacaatgcttctgccttttatgttttatcgttttcagttattcacaagcataatattatgaaattaaatctataacaataatctccatttgggttttgatatcattctaattgaaatagctcactatccacttggtgaagttatgcagaagataaagacattctcagctccaacttactcattatcatggattgttgttgattaagaaaaggtactttatactaccagccatccttcacagaggctctatataacttgttatactgcttaattcaatccataattgagaaataggcagaaatatttaattcactctgtggtcttgggcccagaatacaactgagttttctcgggaattagaaaaactaggaatttgtaaaatgcatgttttcatgtttaattaggggaaatatgtaattatgtctttttgagctgagaatgaattttcatagaactcataattcctgggtattctccatttatggcaaggcagactattaagtgctgggaaattaaagctgtccaagagcagccctcctccaatgagggatgaaaattgattggataagtaccccagctctcaagctcctcagatgggataactctaaggtgcatgttctacattacaggacagcaaactatttctgttaggggacagatactaaatattttaggccttgctagtgacatcatctctattacaattactcaactctgctgtacagagattacagcaatgtacagagttgtaattttgtacaacaaaactagccataaatgatttgtaaataaatgagcatggctgcatttcaacaaaactttatttatgaatactaaaatttgattttttggaggtaatttacatatcacaaatttcttcttttgatattctttaaccattaaaaccataaaaatcattcttagcttacaagctatacaaaacgaggctagatttggcccatggattgtagtttgccaacccgtgttctatattatctcttgaagtttctctggagattatacagtggtatcttcagtggtatcttgctggagaacttggtattgttttcctttttttttttttttttttttttgagacaaggtcttgctctgccacccaggctggactgcagtggcatgatcatggctcactatagccttgacttcccaggctcaggtgattctcccaccccagcctcccgagtagctgggattataggcacgtgccagcacacctggctaatttttgtattttttgtagagacagggttttgccatgtcgcccaggctggtctataactcctgggctcaagtgatccacctgccttggtctccctaagtactgagattacaggcatgaaccaccaaacccagcccattttcctcttcttacctgtctcacttccccattcacctaacagtgttccctggaatcacctcccaaacaagctacatgcatttgaatacttgtcttgcggtttccttcttggggaaacaaaactaagaactgggctgattaatcactgaattgaatatttgttgctcggcatcatgaagaccacaggaaagagtcctagaattctaagaacagatgcaattaaaggctctttccagtacagtcatgagtggcttaatgatggggatacgttctgagaaatgcagtgtcagtagattttgtccttgtgtgaacatcatagagtgttcttacacaaacctagatgacatagcctactacacacgaggccatgtgatatggcctatggcttctaggctacaaacctgtacagcatgtgactgtactgaatactgtaggcaactataacacaaaggtaagtatttatgtatctacacataggaaaggtacaacaaaaatatggtataaaaatggtacacctgtataggatacttaaccataaacggagcttacaggactggacattgctctgggtgagtcagtgagtgagtagtgagtgaatgtgaaggcctaggacattactgtgcattactgtagatattataaacactgtacacttagactgcaacaaatttataaaaatatttttctttcttcaataataaattaaccttagcttaccgtaacctttttactttataaacttaaaaaatttttaatttttttactgttttgtaataacagtgtaagatacactttatatagctgtacaaagataactttctttatatccttattctataagcttttttctatttctaaaattatttctttttttactttttaaactttttgttaaaaacaaaaatacaatcacacacattagccaaggcttacatagggtcaggatcatcaatgttcccatcttccacctccacatcttgtcccactggaaggtcttcaggggcaaaaacatgcacagagctgtcatctcctatgataacaatgccttctggaatacctcctgaaggacctgcctgaggctgtcttacagttaacttttttttttatcagtagtaggagtacattctaaaataaagataaaagtacagtacagtaaatatataaaccagttacagtgatttattatcatatttaagtattatgtaccctacataattgtatgtgctatacttttatatgactggcagtacagtaggttgtctaaaccagcatcaccacaatgatgtaatgcattgtactatgacattatgatggctacaatgtcactaggcacacatcataggaatttttcagctcctttataatcttatgggaccactgtcatatatgtggtccatggttgactgaaagataatttcaagagtcagtgacataattgcccattgaagttatgtggtccatgacttatattctcagactcgttgtgtagtgggttaaaggaataacctttatcattgcaatcttctgacttgcacctgaggtaaaactgggagtgttaatacctgcaatgagcccaaggcagccatttcatcttcttggatccatcactcccgactctcatgctgggtttatcagcagtgaggacctaaaggttcctcacagcagcaggtgccggtgactcagagtcaacagagtcgtgtaacagtctgcaggaatccaggggcattaggcatgatgataactattgcagcaatctctgtagccacagggatttatgaaatgtgttttcttcccaaagctccctgcaaataaccaaagcattgaattatctctagatcaagaacagcaggtggttagacaggacattcattttttggttccatctcactcattttatgtagtaattgctttctctgcaaattgaaaaagctttcctcgccccgttctctgctgttccagatggctgtaccctctcaacctggcaggtgcctgcctgcctgttggcagtgaggctgtgaacttactaagtgcagcattttccaatctccagacacaaatgaagtgatgttgattctctactaatgtcaggcttctctgaggaaaggataggccatgacatgtggactacaagaaattatgaagctatttcaggctctaaagtactagagacttgtgcatggtttaataaaaaccgatttcctctagtcctacttattattcaacatacaacaaaaacataattgtaaacttaaaagtaaaaaaagctgacaacccagaaccagctctggggtatttacaagttctaacaaaatccctccaaaatgtgttttaattgggcttctattagcaagtctaatccactgggactccctaattactaaggtaagtcttaactccctttcatcattattctctctttcagtccaaaatagaaagaaataaatccttcttaagatcaaattttaacttgaatttgagtccagcaaagtaagctatcactggttgtttttgagcctaaccctctagagagcttcattttaaaattcaaatacaaggagattatttatcagtgtggttctggcagtgacataattgccccttgaagtaaacaagttggcagccttgcaaaagaggaagtgattgttatttatttatttattttgtatgggaattaggttctgcaaacaaatccctttgactactgaggcttaaaaaatgctgtatggtgttcaagtgaaaaagcaacatgaagccagtgaatggccatggtcacagggtgggaagtgaagccatagtaataaaaaccaaagtgccaggaagtggcaaaccaatgcccagagctataagcctgctgaaatttctagtctaggttccacattccttcttgaaaaataccttcctcttgatcagacacacaaaggtctgtgtttctgtggtgttatagcatgcagctgggatagagtagggtgagaactggctcaggcatgggacatccaggttatcttcctgcctgtaatagtctctgggaccatatgctgcaagctgaggcagaggagagagaagagctatttcttaccatcatttagctgccaagtcctggcatgctttcaccaaattacataactagagacagcaggtgtgtttcagaagcacatggaccatcaccccacctccccaacacacacacacacacacacacacatacacccctcacctagatctctctccaggtccaccccatcaactatgttcccatctgcttattaatgctggaaaattcacagctagtgtttcattccttggatgtaagcctctggtttttagtaatgtgcatataatcctgggatatatgacatctgaatcccttcactttttaattcaaacaaaccgacaatgtttgctgtaaataactcattcaaaatgctcacaaaattaaagggataagctctattaatcacatctactttactgtatacatgtcgagggagggtgaggcaaagaatgatgcaggaagaggaggctgtgtgatctacctaatgatcaggttgacagaaataaaaactaccattattttagccaactcaacctctaattgccataaacaagattctacacaggtgttcattctttatactttccaagccttactcttttctatgaatgatatgtataatagaataaaattttaaaatgaaattcagatcaaataccctgtttggggacctggaaataaaattcatcagaaaactctatgtgattgtatctgtttggccaacagagatattgttatatggcatttctccaagttcccactcttatttatatcactttcctatcctcataacatctgtgcttttaggagtgtagtaatatacttaactgaatacatttctgcttagccaggaggagatgcataaagatgtggaaatacagaaattgcgatatcatgatagcatagggaaagaggaacactcataaacagagcaaaagttggtggaaaaatgtggccattttatcaaaatgtattatgtgatataatttaatgtagtagtacttttcccagaaacttcattgtataaaagcaccttaacaaacaagtggactgaggtacaagatatatacaagatacaaaaatattcattgtaacattgcaaatgtggcaaatgctggaaacatcctaagtgctcattagtaggttaaataaattatgatttatttacatgatggaatctaaagccactaaaatatttaaataagtggataaaatacctaagatattttattaactgtatgtgtatggtcatacataatttttttacaagtaaaaatgggcatgcacattttcctgtgattacctgtaagaagagggatgttggcaggggaaaaaacttacttttaatttcacggtcttctgaacctttaaattttcttgttgcaagtgatcattcattacttatatgagataataataagaaaataaagaaaaacaaaaaatgggaaaaggagaaaagcaaattgcccttctggaagcatatctaggtgtcattttggcctacattctctcttggagagtggcaatactgggttagaagagatcagcactgtcttccctgatgtgccctgaacatcactgtccctgcatgttttatatattcgtcaccataaactaatatctatcttatttggatcaatgtaaacagctcatagtacctcttggggtaacaaatttcataagtttatcaccctgacttcacagctatcagtgtgcagagaagactatgactctaaacttagtcccttcaatctttaagagctgttttccaggtgcaggattataaaggcttgatgagtaagtcagtgatcatccctctatgtctttcagaaatgtgtagtctttgactctgttactcagctttgcttttccaagcagaagtatcacaaatcttccatctgccttcaaagagagagatcaccagtttgtccaatctattagctgcccttctctgggaactttccacctccaatatgaatttttttagagattttagaatcagaattgcaaatgtttttcccagcatagttgggcagggattttatacaatgttcgctgttttgtttccactgccttttttcttgacaagtccaactgcttggccagctttttggaacaagttatccaactccttttagccattcttttccctctgcaagacaccaaaacctccagataaaaatgaaaaatgttcagatgtgtctaaatcattgaatcccagaatagaactcaaagggtcattagatataatctagtccaaacctcctattttataaatgggagaaactggctgggtgctcatgccagccaaggtgggagggtcacttgaggccaagagctcaagactggcctgggcaacatagcaaaactctgtctttactaaaaaaaattttttaattagctgggcatggtgttgtgtcccctgtagtcccagctactcaggaggatgaggtgggaggattgcttgagcccaggagattgaagctgcagtgagctatgatcattgccatcagcctgggtgacacagcaagaccctgtctctaaaaaatatatattctttttctttttcttttcttttttctttttcttttctttttttctttttttttgttggcagagtcttgctctgtcgcctgggctagagtgcagtggcacaatcttggctcattgcccctccacctcctgggttcaagcaattctcaaacctcagcctcccaagtagctgggattacaggcatgggccaccacgcccagcttatttttgtatttttagtagagacagggtttcaccatgttgtccgggatggtctcgaattcctggcctcaagtgatctgcctgcctcagtctcccaaagtgctgggattacaggtgtgagccaccacacccagccaaataattttttaaataaataagtaaatgggagaaactgaggttcagagaggtcatattagtccattttcccgctgctgataaagacatacctgagactgggaagaaaaagaggtttaattgggcttacacttccacatggctggggaggcctgagaatcatggagggaggcaaaaggtacttcttacatggtggcagcaagagaaactgaggaggaggcaaaaacagaaacccctgataagcccatcagatctcgtgagacttattcactatcacgagattagcacaagaaagaccagcacccatgattcaattacctcactctgggtcctgcccacaacatgtgggaattctgggagatacaattcaagttgaaatttgaatggagacagagtcaaaccatatcagaggttaatcaaggactctaacttaaatctcccaacttccatgccagccccttctccaccacatttgtgtacaagagatagccaaaatatttaatacctgtatatggcacaggcactggactgaagacccacctgagtatcggggcagggtcctgaaggcagcccaatgtggtgggcaatagctctttattttctgggtcaaagagtgttctgtggggtcctgggggaggagcagaggtggtttcagtgccaggtggagggagagtgttgtggagctcggtgcaacgtctcttgaccaacaagtatggaagtatttaaatatattaacaactgggacagtcgtcctagtgtgtcccaggtgtgcagcagttgcattggtctaatttagataaaacttaggtgtacattttttcttcatttgtatactttgatgtgtgaagactcagaagctctggccaagtgatgtgctttaaatctttcaatatttagacatcataaaaatgctaagtgctctggacattacacataattaaacaaagtcctaggggtcttacaggcttttaatatcagtcatgaaaatgaactcttttttttttttttttgagatggagtctcgctctgttacctgggctggagtgcagtggcatgatatcggcttaccataatttccacctccccggttcaagcaattctcctgtctcagcctcccaagtagctggggcctcccaagtagatgggactacaggcgtgcaccaccatgcccagctaatttttgtatttttagtagagatggggtttcaccatgttagccaggctggtctcgaactcctgacctcaagtaatccccccgccttggcctcccaaagtgctgggattacaggcgtgagccactgtgcccagccgaaaatgaaatctttaaattgcaaaatagatgtagctacacagaaatatgaactctctaaaaatgcatgagctgctgcttatccatcttcaaggaaaaatgagtcacagtaatgtttccctctgtgaaacagattttaaattgtgatttatgcagtttaaaagcagctaagtagcctgtgtcagtaagactatcatgagatggtttgatggagactattttggataaattaccaaatcaactcaattccccttcctcagagccaaagagtaaagaatacccaggaatggctgtgtgtgtgtgtgtgtgtgtgtgtgtgtgtgtgtgggtgggtgtgtgtgtgtgggtgtgtgtgaagaggttctttgttctcttgttgttttcctctctccagcccctcaggaggtgctacaaagacacagcatacgtgaaagctaaacaacagcatgtacataaatattcctcctcctcccctgcctaaaaccaaaacatctatctcacagcttgaaatcccagcatttcatctggcctttaaaagtccccaaataaaacaaaattattcctgaaaagtcttgaatacttgaatctcttttccaccacagaaaaatggggtttagtttcccacaaaaaaatattttctcatctatttatttaacagatctttcaaaaatatcaaaagttaaatcacactttgtcccacttttaaagaaattgccttattgaaaataaagactatataatagagatatagaagaggcttaaatatatattgaatgtgggatgaatgaaaaaattaatcaatatgtatgtataccaattagacctcagtaaacctgcttaaaattaattcacaggaagtttaatacttgacctggggacttctgatgccatctgtatcatatagagttcaatcagagaaagaaaaccactacatacacacgtacacacgcacaaacagatttaaccttacacaattgtggaagttggttaagtagtctcggtaaggttgtctttgccgcctgtgacgctggagcttaaagtccacagggcaggcagttagggaagggaagatggctatgaaatgagggaaagcaacaataagctggaacccacaagcacaagctgaagacaaggatgggctgaaacctgtgacagttcttgttgattctgaccttagcattgaaagaaatggcaaaaaactgcaattacctttgcacggacctaatagtatgattgttctgtggaagctggggagccttcatcacagagctaaacccacataccttacacaggagtagaagcattggaaagaggagtcaggggagagtggagcagttaaagcccagctgctgactctctccaacgaggacagttagcagatcagtgacaatgtgtgagttacaaaatggctgttgttctcttctgctatccaaatcttacataagaatttatcttctggcccactttaaccagaaacatataggaaggggatatcttaaaaatgtagttgagccttgccaagttgacacattccaaagccgtcataatagtcaatatattgtagggagagaagtgttaacatatttctgagaaccaggttttcaaaatgtggaactgaaggtatttactcagcagggtaaagaagagggcaagggtggtgcaaaaagaggtaacaaagcatatacttatttagtcactctctctctcctttcatttattaaaattgtgtattatttattctgtgtcggtcctgtactaaattgtatttgccaaaaatggccacaatatattccttccagcacaatcaccttacattgtgatgttaacactcctgtatcaagagatgtggtctacgtttactccccttaaatgtggacaggactgagactatggcagaagtgacactgcatgacttccgaggctagctcataaatatgattaatttccactgggctctctatctttctggagactctcatcatttaccccatgttacgaggaagcctaacctatatggagaggtcacatggagatgtcccagttgacatttccaaccatgatctcagcataaatcagccagcatcgatcactaaacatgtaagtgagtgagttttcagatgatttctgcccccagtctttaggcatcccttcccctccaaaataaagaaaacaaacaatgccatatggagcagagagatgagccattccactgagtcttgctcaaattacgaatttctgagcaaaattaatgttgtcattatttcaagctaccaagttttggggtaatttgttacacagccatagtaactgaaacaggctctttgccagaccaataaagtatataatggacaatatatattatgttattaaattgtacataattacctaaatccttttgctttaatattggttaaattggcttgaagttaagattttaatcaatacttttgtgtagtgggtttttttaacttttttttattattatactttaagttttagggtacatgtgcacaatatgcagattagttacatatgtatacatgtgacatggtggtgtgctgcacccactaactcatcatctagcattaggtatatctcccagtgctatccctcccccctccccccatcccacaacagtccccagagtgtgatgttccccttcctgtgcccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacaatcctttgggtatatacccagtaatgggatggctgggtcaaatggtatttctagttctagatcccttaggaatcgccacactgacttccacaatggttgaactagtttacagtcccaccaacagtgtaaaagtgttcctatttctctacatcctctccggcacctgttgtttcctgacttttaaatgattgccattctaactggtgtgagatgatacctcattgtgattttgatttgcatttctctgatggccagtgatggtgagcattttttcatgtgttttttggctgcataaatgtcttcttttgagaagtgtctgcacatctccttcgcccactttttgatggggttaaatggaacagaacagagccctcagaaataacaccgcatatctacaactatctgatctttgacaaacctgagaaaaacaagcaatggggaaaggattccctatttaataaacggtgctgggaaaactggatagccatatggagaaagctgaaactggatcccttccttacaccttatacaaaaatcaattcaagatggattaaagacttaaacgttagacctaaaaccataaaaactctagaagaaaacctaggcattaccattcaggggacaggcacgggcaaggacttcatgtctgaaacaccaaaagcaatggcaacaaaagccaaaattgatgaatgggatctaattaaactaaagagcttctgcacagcaaaagaaactaccatcagagtgaacaggcaacccacaaaataagagaaaattttcgcaacctactcatctgacaaagggctaatatccagaatctacaatgaactcaaacaatttttttaactttttatcttgagataaatgtagatttgcatgcaggtttaagaagtaatacagagaggaagatcccgtttactgtttacctagtttcccttaatagtaacatctttcctaactatagtacaatatcacagccaggaaattgatgttgatacagtctaccaaacttattcagatctcaccagttatacatgcagtcatgtgtgtgtatttagttctatgcagttttatcacatttgtagcgttatgtgatcaccactatagtcaagatagagaatagctgggtgtggtggcccatgcctatagtcccacataggaggctgaggcaggaggattgcttgagcccaaaagtttgagtccagcctgggcaacatagtgcgatcctgtctctacaataatattaataataatgaaatttaaaaaatacagaacagtcccattacaaggaactccttatgcaccctttatagccacagccacctcccttctgccaccaccacccgccaatccctagcaaccattaatctggtttccacaactatgattttgtcatttcaagaatgttatataaaattcattcattatggactgaataaaatcatgtggtatgtaaacttttgagattacctttttttactcagcataattccctggagatccgtctaggttgttatgcatattgatagcatgttcctttttacagctgagtagtatttcatggtatggatataccacagttaagtgttcactccttaaagagcatttgggtcatttccagtttttgaatattataacatccacgtactttttttgtgtgtgaacatacattttcatttctctgcgataaatgctcaagagtgaaattgctgtgttgtatgataaacatgtgtttagtttgtaagaaactgtcatgttctttttcagagtagccataccattttccattccctttagcaatgtatgagtggtccagtgtctctacattatcatttcaatacgtgtgtagtgatatagcaacttttttttgtaatatgatctgactagatatgtgtaaactctgttccttcttgttttcaccagggatcttattttcttcagagcttctaggcctagggcctgctgagaaatttcacacctatgtcaaatggtgaggggatcttttgttttcttaacaccacctcgttccccttgaccatccttcatgagatggagaagaaaatgagttatgtgggctccatagctaatggctggctttccttttttaaagaaactactcctaatagatatgcagaggctttgttccaaaaaaaatttaaatacattttctgcaagatattttaagtaaaaaaaattcaagataaagaatgataaggttagggacaagagtaaatataaggtttaatatataaaatgcatgaggtctcttgcaattgagtcacaaattttcctgtacattcgtagagttaagagagaaatgtggtgaattatctatttcacaacactcatagggaaataataaaccagtttctcacagaaacccagcctggttctgtgaccagagtggaaattcccccatgtctacggaggccacgtaggtaatgtaagtcagtgaaacagattgggaataagacaatagggagtaggggctggggctgagtcaaactggaaagcacatgcacagtctaagggcagctactactactcagcctcagccaatattccagagggaagcataagccctgtgttgccagatttattttgacttttaatatattagcaactatatcagtgaaaataataactgaacaaaatgcttctgtagtccagagctggtcaatcgctgccagtttaaaacctctggccttgaagagtaggcagaaacatctaatgcaagacaatccttataaatatgacctctttcagcctagctttgggtaactattgaatgtcactgagtcggtgattaagctttctgacatgcacttagaatgaagattgtatggatggtcaggtatggtgtcatacactttcatagtcagccaacaatagtaaaaatatgaacaaaagacttgaacaggtgcttcacgaaagaagatatccaaattgccaataaatatattaaaagcgctcaatgttattagtcatgaggaaaatacaaattaaaaccacagtgagataaaactacatactcactaaaatgataaatataaaaaacacccactcaagtgtgggtgaagatgtggagtaattggaatgctcgtacattgctgataggaatgtaaacttgtacatccttgtcatttctaatgaaatttaagacattccttcctcatcgcctagcaatttctttttttcaggtcatatccaaatgtttatttaactcataacctccataacacattaagttgaacttacagaaacgaaagtaaagcattggaaaattgatctgtggatacaggatatttctataggaaacaaatgtaaaacatgagactcaatgagtttgatggtgataataattaatgcttaggattcaacttatattctaattaatctaattgggttaactacaatcatgaaatattccatattttcctcttatgactttgtttttgtttgtttttttaaacttttattttaggtttaggggtacatgtgcaggtttgttatataggtaaactcatgtcatgggaggttgttgtacagattttgtcacccaggtactaagcctagtatccaacagttaggttttttgtttttttgtttgtttttctcctctccctcctcccatccgccacccttgggtaggccccagtgtctgttattctcctctatgtgtccatgtgttcctatcatttagctcccgcttgtaagtgagaacatgtggtacttggttttctgttcctgcattaggttttttttttttaatttttagtttttttatttcaataggcttttgggggaacaggtggtgtttggttacatgaataagttctttaatggtgatttctgagattttggtacacccatcacctgatcagtgtacactgtgcccaatgtgtagtattttatccctcgccacccccaccctttcctcccaagtcctcaaagtccaatgtatcattcttatgcctttgtgccctcatagcttagctcccacatatgagtgagaacatacaatgcttggttttccattcttgagttacttcacttagaataatagtgtctaattccatccaggttgctgtgaatgccattatttcattcctttttatggctgagtagtattccatggtatatacaccacattttctttatccactcattgattgatgggcatttgggctggttccatatttttgcaattacaaattgtgctgctataaacatgcatgtgcaagtatctttttcgtataatgacttcttttcctctgggtagatacctagtagtggggttgcttgatcaaacagtagatctacttgtagtttcttaaggaatctccacgctgctttccatgtaggttatactagtttacattcccaccaacagtgtaaaagtgttcccttttcaccacatccatgccaacatctatttttttttattttttgattatggccattcttgcaggagtgaggtggcatcgcattgtgattttgatttacatttccctgataattagtgatgttgagcatttctttcatatgcttgttggccatttgtatagagaaaatcttcacagtctatacatctgacaaaggactaatatccaaaatctacaaagaactcaaataaatcagcaagcaaaaaacaatcccaaaacttctaagtatatactaaccaaaagaaatgcatgtatatatccatagaaagacttggacaagaatgttcagagcagttttattcagactagccgttaactgaaaacatcccaaatgtccatcaacaagaaaatgagtaaacaaaaaactttggggtatattcatacagtgaatgagcaatagaaagaactaattgggatgcatccaacagcatggattaatctcaaaaacattaggttgggtgaaagaagccctacacaaaagagtatacactgtatgattccgtttatataaggttcaaaaacaggctgggcatggtggcttgtaactataattccagaactttgggaggccaaggctggaggatcatttgagcaaaggagttcaagaccagcatgggtaacatggtgagaccctgtctctacaaaataaataaataaataaataaataaataaataaataaaattagccagtcatggtggcttgcacctgtagtcctagctactagggaagctgaggcaggaggatcacttgagcccaggaggtccaggctgcagtgagtcatgtttgtgccactgcactcctacctgggtgacagaatgggaacctgtcttacaaaaaaaggatttaaagttcaaaaacaagcacaacttgttgtaattttaaaactggttgcctctgtgggtgggggaactgactttaattctgagagatgggaatgttctatatcttgagttgggtggttacatgttgtatatttttgctaaaattttccaaactgtactcataaaatttgcacattttactatatgtaaattatacctcattaatctactaaaataatagttgggtcctggaaaaaaaaaagcaactggacaaggacactgctagcctggcccaaccaaactatccagcttcacacagggaagaaatgtcagcctccatgttggcatgttgtacttgagtgcatgtgttgggctagttcccacacagaaatggcaaaacatgcttatagagtgcccgagagagaaaatccttctttccccagaagtttcctaccatacagagaggcagtacatgctaatggctaagaaaatgactttggagtcaaataacatagattcaaattttgtctttcccaaatattagcttgatgactttgaggaaattgttactgttccaagcctctcattgctcatctataaaatgagtatgataataccttcttcaaagtatcatcatggagattgtctgcaaagtgctcacttagcacagtaacacccatatggtattcaataaattgtagcatttcattctatattcatatagggaccaaatgtctgaacatctacctttcaaagcttatctaacatcttctccttaaagaactttccactattctaagactcctaggaagagtaacatactgagttcttaaggccttagtgcacattacttttagaaaaatatgacttccctcagagagaagcaaggtgggtaggtcatagggtaatttacttgacatagatgtaagggaaagcactgctaaaggaagaggtgtcatttaggattcctgtttgcaagtaattgaaatgatctttggcttaacagaaggcagaggctggaaaatcaggcctaggcttacagaaaccaaggtcactctgtaggcctaggccacacaattcataccaactaacttaaagtaggaagtaaccaataaacgcatgacctacatttgtttcattgcatcaattcctcaagatccaaagtttggggaaagagtatcagagttgtctactttgcagccccaacagtgtgaaagtgttcctatttctccacatcctctccagcacctgttgtttcctgactttttaatgatcgccattctaactggtgtgagatgatatctcattgtggttttgatttgcatttctctgatggccagtgatgatgagcattttttcatgtgtctgttggctgcataaatgtattcttttgagaagtgcctgttcttatccttcgcccactttttgatggggttgtttgattttttcttgtaaatttgtttaagttctttgtagattcaggatattagccctttgtgagacgggtagattgcaaaaattttctcccattctgtaggttgcctgttcactctgatggtagtttcttttgccgtgcagaagctcttcagtttaattagatcccatttgtctattttggcttttgttgccgttgctttttgtgttttagtcatgaagtccttgctgtaaactagttcaaccattgtgaaagacagtgtggcgattcctcaaggatctagaactagaaataccatttgacccagccatcccattactgggtatttacccaaaggattataaatcatgctgctataaagacacatgcacacgtatgtttattgtggcactattcacaatagcaaacacttggaaccaacccaaatgtccatcaatgatagactggattaagaaatgtggcacatatacaccatggaatactatgcagccataaaaaaggatgagttcatgtcctttgtagggacatggatgaagctggaaactatcattctgagcaaactatcgctaggacagaaaaccaaacactacatgttctcactcataggtgggaattgaagaatgagaacacctggacacaggatggggaacgtcacacaccagggcctgttgtggggtggggggaggggggagggatagcattaggagatatacctaatgtaaatgatgagttaatgggtgcagcacaccaacatggcacaggtatacatatgtaacaaacctgcacattgtgcacatgtaccctagaacttaaagtacaataataaaaaaaaagagtttttattattaaaattgtatgctctcacagggcagaaactatagctattcttcatttaaaaaaaaaaagagtatcagatttgtggagctcagaccaacttctctttcctggctctcaaactaggcaaggctaggaaagactggatgtcttcggcttccaaagggtggggcaggaacctggaattaccttacaccaagactaccctaatcagggagagatattcgccaaaagaaaattggggtgccctgggaagtggcagtggatactgggcagctggaaagtaacaaatatctacaggaacacagggcacagtagtggagggccagaaaataccatttcccccttcttagtgggttcttaagagaccttgtatttggagctcaacagctttttggtgatcctattattaaattaatctcaacaacagctctgagcagtagagagggactatcaatttatttccttattagtgacctgttctgtctcattgtatttatttcttaacagttcaattgctttctgtggaggttagcaggaagcccagagcaaatatttaagagcatcatttgttatatgttacatatattatatattatatatactatatttttacacatataaaagttaaaagattagggtgacttcttgcacaaatcttagtaaaacaactgtactagctagtaagttatatgcagtagtcattaaaatgttgaaatatagggaaatgtaaattttagctcatttaaatatttccagaaaaaatattttattttcatagaaatgttactttggtgttgcctactacaacctttttgggaagaaggaggccaaaatataaatttgaaaattgtacttaaaatttattttaatttttaaatttccctcagactttcttatatacatttttcctcagcttgagagaaatcatgtgctgccatactacattttttaattcaatatgaactttattagaaaatatttttacttcagttaatctttctgtgtgtgtcagtgtgtgtgtgtgtgtgtgtgtgtgcacatgcacgcgcttataaagccttggtaaattttgacaactgccttttctgagtggtataatatcatagctcttttgcaatcattttgaattacgtgtacatgtcaaccaattcaagtacacttctgctctataggcaacttcatttagtttaaaaaaaaaccttgtttttaccataacactgtgcttcacaaaaaatgataataactttcatattatatcacaaaacaaataactgaatcctcaatgttgaacttttaaaatgaattttcaatagaattcaaaacaatatcatattttccctttgacagaatgaacttctaaaacttttactttgatacaacgaattgggtgataaaaatttagccatcattggaattaacggattgttttatttgaagcattcaatatcactgatataaaactgacctcacttaattctttgcaaaactctgctaatgaagtgaacacaataacatctatcagttcatttttaatatatgcacatgaacacttggaatagaaatgaatggcattaatttaggaaaatgatgatttgatccaaattaaaagtcatgctttactgagtgatatgtaaatacaccttctgaagtcgtattaatacgtgttaaatggccatcttcgggcccaggcttcttaaattaactatgaagttttgaaactacgaagttttctaagtgcagcaaaccaccatggcacatgtatacctatgtaacaaacctgcaccttctgcacatgtatcccggaacttaaagtaaaataaattaaaaaaggaaactacgaaattttgaaataaatgtttatgtatctttcacagatctacctcctcagattttatatagccagtcaatattattttggctcccagggtggctggtaaatggctcctaaacttttatgcaaattacatgtccatgatcaactttcttgagaaacggaaagtcagtagttcggttgttattaataatcatgtgcttcatttttttttcagaatgaagcatcttgtttacggcttaatatatatgcatataaaacacacttctgtccactcccccataagcgggtccaggcagctccttcctacagagggtagggaagagggccatcagggcagtgcctattttctcaaaggcacttaccctcccctcccgaaatgctccatgcctccagttccaataccgggggccaggcaggaagcccctctgaaaaagaaagggcccccccaaaactcccaccccaccttggtttgagctgcagttgtggaggaccttgctgaactctttggcacccctcatttctgctccctgttacatcatccaagccagaagcacaagtcacaggtaggtggggtggggggaactggtctggtgttggctcagtcaggtggttgctctccctggaggactccccagggctgatgtctctgaggctgtagaatcctgatttggactcctccagccccatattcccaccatattttgtgaggtgagctcctgggctctcactggctgcctgagggtggggctgatctcagttggagtcagaatctgaggagtcccttgaagaggaagagctggtggattcattatcttcatcctcactgccatcctcctcatcatctttatccttgtcatcctccttattcttgtccctatctttgatctcatcctcaatgctggacttggaggagtccccaccatcagaggagtcactagtctcatcatcttcctcttcttcctcttcatccttgctgtccttctcctcagacttctaattggacttcagggtagtccagctggacttggagttcaggtctcaaagcttagtcatgctcttatgttcattggagatgtactctttgtaaattacatggtcctggggagacagactcttgatgcagaggcccaggtgtaccttgcacacttctgctgcttcttggccagctttttgtagtgctccttctggctctgggagatgtgctgccagcggctgccattctccaccatgcgctccttcagtggcaggtggttcagctccccattggacagcagctcctgggaactgttcatgggaggcttcttggtttctcccaggaattttatcttcctggaagagtttctagcaaccagaggtgcctgcatctcactcggctctctcttgtatcacttttggtgtttagctgccttcttaatccatagcagtttctccttcttctttatgttattccaggtcatctccatggcttttgaggccttcacccagttgttcttcaattgggccatgtagtcactaatgatgctctgttaccagatcttctctgctgtcttgggtgactctggcagcttgccctgtgcctggtgctcccccctgggccttgttcttggccttcttcttcccagatcattccacatttgggccagcaggtaggtccactcactcccagggagctcaggctgctcctcccacagctgctaccacttctcctcaaaaaaaaaaaaaaaaaaagaaaaaaaagaaatgaacacatccaatatgggccacttaggcttctctgagctgtcctcacccccatcttggggtggcttcttggaggccaggctggtggcttgcttcttgttgctattcaacatcttctccttccccaggacccactactgctcctccctggggaagtctctcaagtaaatggaggagctccacctcataatgtttctttttctgaatgcacttcatgtgataggcatccttctccttgtgggagaggagcttccactgttggttgcacagcaccatgtactctctgctgggtgtgtccttcatgtcagccatgagctcttctcagtacggcaagtagctgttgggaagtggcttggtgggtcatccatcaaacttgtccttgagctgccattctcagccttggtgaaggtgaacttggtgatgccgaccccactgatattcggctcaaggtgcttctggatatagtcccacatggtctcctcatatttcttctgctgatccagggccttactaatccatttcagcctcttgttgtcccagagctgagaccactgcttcttaggaagtccttcaccttcttacctgcttcgtagtggcatctgggctcactttgaaatacaccttcttctcatgagtgtaccacagttgctggggaatttggggcttcttggggatatctgacttcttgtcattctggattgggtcagagtgatcctctttgaattgggtcaggtttctacagacttttgtttctccttatggaagccctgcatatattttatcttcttctccggaagctgcttggatttcttggatataatcttggtcaggtccagattgctcatctcaaggggagtttcacatacttgttgtgcttctccatgaagaagggaaataaggaagcagggaattccttgggaaatctgcagggtttttttgtttgtttgtttgtttgtttgtttgtttgtttgtttgcctttgtaaggatttgtaacatgtttctgagcattgaggatcaattctgtcaatgtatggaacttcctggccttgttagaaatctctacccattcaagcttacacatgtctacagaaaagtccttaaatgctacattttcccactccgtatgtgacttggtagttttgaacttggagctgtcattgactgtaaagtaatttttcaagcattgtggcaaagtcatcatgtcttcctggtaccagcagtcttggcctttggggatggccattttcaggtctgtggggcagtcagtttttctctttatcctccaggtgtccagctacctcttccatggtgctggctggcaacccaggatcaaagccacctcaccctttagaagacataccaattcccactcaggcaggctgagaggtgagggactttctatccctctcccctctcaaagaggaggtgggcacaggtcccacactctcagagataaccagccaagaccctaatagacttaatgggttggtagatgtgggagcatgctcctccccttcttcctaacctctcccctatcccctgcagcctggctccgtggtgtgcacactcccctgcccactggaaactgctttctgcttccatgtgcagtgagcacccaccctctaccttccttccccaaccctggccaacaaaaacctcctcctccttggagcacccaccgaagggaggctccaggctacagggcctgcacttcacttttaaaaactcattgtaactaaaagggtttgttgaaaagtaaatgccccttgtaagttggattcctaagtattttattctctttgaagcaattgtgaatggaagttcactcatgatttggctctctgtttgtctgttatcggtatataagaatgcttgagatttttgcacattgattttgtatcctgagactttgctgaagttgcttatcagcttaaggagattttgggctgagacaatggggttttctagatatacaatcatgtcgtctgcaaacagggacaatttgatttccttttttcctaattgaataccctttatttccttctcctgcctaattgccctggccagaacttccaacactacgttgaataggagtggtgagagagggcatccctgtcctgtgccagttttcaaagggaatgcttccagtttttgcccattcagtatgatattggctgtgggtttgtcatagatagctcttattattttgagatacatcccatcaatacctaatttattgagagtttttagcacgaagtgttgtggaattttgtcaaaggccttttctgcatctattgagataatcatgtggtttttgtctttggttctgtttatatgctggattacatttattgatttgtgtacattgaaccagccttgcatcctagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttgttaagctattgattattgccacaatttcagatcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggattggtggtgatatgccctttatcattttttattgcatctatttgattcttctctctttttttctttattagtcttgctagtggtctgtcaattttgttgatcctttcaaaaaaccagctcctggattcattaattttctgaagggttttttttgtctctatttccttcagttctgctctgattttagttatttcttgccttctgctagctgctgaatgtgtttgctcttgcttttctaggacgtgaaggacgtcttcaaggagaactacaaaccactgctcaatgaaataaaagaggatacaaacaaatggaagaacattccatgctcatgggtaggaagaatcaatatcgtgaaaatggccatactgctcaaggtaatttatagatgcaatgccatccccatcaagctaccaatgactttcttcacagaattggaaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactagtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaactctagaagaaaacctaggcattaccattcaggacataggaatggacaaagacttcatgtctaaaacaccaaaagcaatggcaacaaaagccaaaactgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgccggagaggatgtggagaaataggaacacttttacactgttggtgggactggaaactagttcaaccattgtggaagtcagtgtggcgattcctcagggatctagaactagaaataccatttgacccagccatcccattactgggtatatacccaaaggactataaatcatgctgctataaaggcacatgcacacttatgtttactgtggcactattcacaatagcaaagacttggaaccaacccaaatgtccaacaatgatagactggattaagaaaatgtggcacatatacaccatggaatactatgcagccataaaaaatgatgagttcatgtcatttgtagggacatggatgaaattggaaatcatcattctcagtaaactgtcgcaaggacaaaaaaccaaacactgcatgttctcactcataggtgggaattgaacaatgagaacacatggacacaggaaggggaacatcacactctggggactgttgtggggtggggagaggggggagggatagcattaggcgatatacctaatgctaaatgacgagttaatgggtgcagcacacaagcatgtcacatgtatacatatgtaactaacctgcacattgtgcacatgtaccctaaaacttaaagtataataataatttttaaaaaataaatgcatcatcaaacaataaaattattgtagattagcatcatacaataaagaaaaaaatactgtagtaagagcattcaggctaatctctatatcaagggtcaggccagatctaacctataacctgtttctgtaaataaagttttattggaacacaggtgctctcatttatgagtattgtctatggttgcaacagagatcttatgactcacaatgcctaaaatatttaccatctggcactttaaaaaaatgtatgctgacccctactctatatgtaacatggcagggatggtcagcctctatttccaatacatattttacatacacctaatccagggtttcccaaccttggcactattgatgttttgggttgcataattcttcgttgtggggggtactgtcctgtgcatcatgggatgtttaacagcatttgtgatctccagtcactaggtgtcagttagcaccctcccacttttgacagtcagaaatgtctgtagacattgccaaatatcctctagtgggcaaaattactcacagttgaaaatcactgacctaacttgtaattttgtactgatctcacaaattgggacatggcagtgtcatgcaacttgaggctgtaacttaatacatagcacaactggctgctacttcaagtggccagtggaagcaaagcaatgtggaatacttttcccactaccttccaaggccatgaaacattagctatctctagtcacaaatcgagtgccctgcattctgtctttagaaagaatgtatgagtttctttgtgtttgaaaaaggtcaggaaatgagtaacgggttattgttaatcattttttagatttaactatgtgttagggcgagaacttggttcactacctatgtatattacacactgctacaaaagattatgacagaatcttcaagtataaagtggaggtctactaaatctatcaaacaatgtgagctgaatgagtaaataagtaatgcataataaatccactacaaaatttctaagtctttggattccttcacctatatcatactgagaaacttttaacatctcaacttcctttactctggcccccttattgagttcaactaaacaaacaactggaactactcccagcatcttaacctaacacaatggaatcagaatctcctggtaagtgcttcttaaacaatgaactcagccttatctagtattttgtccttccttcattggtatagcacccactgaacctattatgattcttgccaatatacattagtaaatttgcaatttggcaactggagactgccatgacctgattttagtttaggtgttgcaataattagaggtagtgggctaaatagaattttctccccttttcaaggtaacactctcagcaaggttgttacagggtcttcaaagaatggcggaacagcctcataaaccaggagagaaaggaagattctatggtttggggtactgagttatatgagtcttgccatatgtccccatttcagttcttgggatctcactctctcctaatccaaatataacttttatgtaaaatatctggtaaatcaaagtttttatgcagcagcccaagaatcaaaatttgagttttgttttcaactatctcgctccagtggctgcaagtgataagagattctttgagaaaaatcatagaagttccacaattttttggatttgtcttgatataagacattaaggctttgaggttgcttttcttttctttaagctgccaagttcagctagaagcagcgctatactatgcctttcatattattctattccaactaccactagatccttcagagtcttgcccaaaatgagcacattattactaatgagcatagataataattagctatttctttgatttgagcatgtcttggactactggttgagtctttagagatatcaacaacaattagaagaggtaataaatctgagatttccccttattttcctgaggatctgttgcttgccacctcttttggtaccaatttctcaatcaggttggttattaagtagaaaagtcattcattaatagttctcacaattgctcagagccctggtaaattgagcttgaagccaaacttccaggaatagatctgaaaccatgcctcaaaacagacttgataaactactgccactgattgctagaggaagcctgcattgccactatccttacgccacatctatggcaggaactcaactttgcaatcaccagaaagctgctgtcattgtaccagtagatgctaggcacatctccaggagaaatggaagcaccaaagattgttgccttataaaccacaatctcacatggatgcatttgattgctgggtctaggtcacatctatgtacagtagttgcaagtggggctgtgaatttgagtttatactcttatgttggagtccaaaggccagggagcctggagttgttttccaaggacaggagaggaatagtgtgtcccagctttagcagatccacacattcatcttttctctgctttgttctttctggacccccaatagattggatggtacctgcccacatagagggtagatcttctccaccaagtctattttgactcacagctaaactcttctgaaaacaccctcacggacacactccaaaataatgctttaccaggtttctaagtattctttaatctcatcaagttgacacctaaaattaaccataacacacacaccatcccaaaatttaatgttttaaagcaacatttattttgttcacaaatgtgaaatttgggcaagaaacaatctgtttcattcagtgtaagcttggggatagaatcacatgaaatctcagtcactcacatgtctagcgactgatgatggctttcaggttgagactttaactgaggccattggccagacacctacatgtggcctgtccacgaagaaccaaactgtctacccccacacagcttactgtctacattaacctgactttactattccattgtctttgttagtataactttggtattccagtagactattgcccagaaagacaaaagttgcaagtaaaattattgttctttacaggagtttctgaaagttgtatcattcttcagtagaagagtttacatcgtaagattatttgagcctctagcctcaaaacgcttaccttgtagtatccaccaatcctaagatccttatcctattctaatcaagctcctgtgttgaaagactctcataaaccaaactcccagctctcaatatagcatcagactttgttctcctgttctgagactctctcagattccatgaagtatcactttaagcaatatattcaacttagtcttttcaatgtgttgttctggtgatatttgggaagccagcatttgacaccatgtggcctgggcttctttacaacatggtggctaagtttcaagagtgagtattccaaaagaaagctatgtagaagtgatatagtctttttaaagataagatcagaaatcacacagcatcatttccactacattccagccatggaggtaaccacaaatgttcacccaggttcaaggaaaaggggattagacaacaccatttgatgggaggaatcaagaattttcagacagatctctaaaccatcacatcccctaaactcaattaacattgtctacaggttcttggaaactgcaattttaggtacaatgcctaaggaagccaacttttccataggctaattgatataaacaagagtgatgagattgatataaacacgagtgatataaacaagagttcctatggcatacttctggtcacaaaaacatcaccaaacttctaaataaaaaccaaaacacatctaatattaaatatattgtcgtggggtggggggatggggagggatagcattaggagaaatacctaatgtaaatgacgagttaatgggtacagcaaaccaacacagcacatgtatacacatgtaacaaacctgcacgttgtgcacatgtaccctagaacttaaagtataaaaaaagtataattatcaccaattatttgattttgttcgtagaaccataccaaatttgaagaaaaatgaaatcaatgagaagctttgtttctaaggtttaaagttaaaagggcaattgcagttgtccaataactaaagataatttaattacttgttgaaaattattttgccttgattatctaggaattggtaatcaaaacataagagcatatttttgaaactgataaactgagttgttttctttttttcttttttttttttttttttgagatggagtttcacttttgttgcccaggctggagtgcaatggcacgatctcggctcaccgcaacctccgcctcccgggttcaagcgattctcctgcctcagccttccaagtagctgggattacaggcatgtgccactatgcccggctaattttgtaattttagtagagacagggtttctctatgttgaccaggctggtgtcgaactcccatcctcaggtgatccacccgcctcggcctcccaaattgctggtattacaggcaggagccaccatgcccggccatgaggttttttaacataagcatttcttatttcaaaaggaaggtagtagttctaaattttaattctacacctcaaatgtaattcattttaacattttatctgcatctgactgatttcatcaatgtaaaataaagcaggtggcccaattcaggcaaacatgtactgagcatctgttgaatgaggccttgtgctaggtgtggcaaagaatatagagacaagaataaatgctcatttgtggtttactaaacaagagaaccaataacttcagtggtgagatgtccgggaaaattttataagagttgctactgataagctcaattccactttctgctagggaagagagaaattgcataagaggataaaataataaaactcggttttggctgagttcccaaaggtggaggaaaaccagtaaattccaaatacattcacatgccagagtgaggcatcggacttgcaaagaggatggagcaaaagcaatagttttcaatccttaagatatcatctatcttgaagttacatcattggcttcaagatggccactcagcttcacatatgcctctgaagcttgggagactgatgtctaacactctcagagataaatccaaaagaaagtgaatatggctgatgctgaccctgcctgataacacattgagagagtactgcattagaagtgagatgcactttcgctttcaagcaacagtggggcaagggtgcttgaattttcccatgggccaatggaagggtggaattggaattctgcccacgaggattcaatcctattctgcttttctattccagagcctttccacacttactcccacaggctgagcaaagcgcctgcattgtttcaagtttttccctccatgtagacaatggatggatgctttatttctccagtgctcatgggcctaatgattcatgactgtgttagccccttttaccattttcagggcttgcaggaaaaataatcctaggagattcatacttagagcagaatgcggcccaaacacctggcaatcatgttcatcattctcattttttacctagatcatccttgatgccagagcaaggtttactcaatctgatggacatgccttttatttctcttggcatcacccacctctagatagtcataaaggatagcggatggcttattatgtcaagtatttctctcataactaaataaattatatagataatgcagtgtctgtaagtacttgaggagacttggaaaccttttacggtcatcaaaatgaatatttttctattcatcagcattcacaactattgaatctttatctgtttgtatggtttatactggggctttccacccctgcccccccgccattattatttctccacttggccattcctattcagagcctttcaccttttatctctgacatagcttggttcaagagcttaattttttttaaggtaccatgaccaagtcaatttatatcctgaagaagggattacatgattattcaaatttggcattgctacacatagaagatatctgtgtgatttacttacatttacatattgactttcatgatatctagcttaaatcttgacagatgaaggaacacaacagcagactttgggaaacattttttcaattaatagtacatttcgttatactgagggaaggattgaacatatacatttattattttagctcagttttgagatggtgtacattttttgcttgttttatgtttatactgccagtgtttgaaaataaatattcataattcctccttttttacacaaaagttacataggcactatattgtaacttggcatttttagttaatgatatattttagagtttgtagtatatcaggacataaaaagcatcatcaatctttttatagttgcatagcattttactgtgtggatgtatcataatttctttctttctttttttctttttttttgagacaaagtctcaaaagcctgtcgcccaggctggagtgcagtggcgcaatctcggctcactgcaacgtccgcctcctgggttcaagtgattctcctgcctcagcctcccaagtagctgggactacaggtatgtgccaccaagtctggctaatttttgtattttttttttttttttttagtagagacgaggtttcgccatattggccaggctggtctcgaactcctgacctcgtgatccacctgcctcagcctcccaaagtgctggggttataggcatgagccaccgcgcctggccatgtatggtaatttcttagacaaatccccaattgttggacactgggtagcttccaaactttcactattaccaagaaaacctagctacaacaaacaaccttgcctatacgttttcttatatatgtgtgtgcatacatgtatgcacatatacctatccagaggtagaattcctgagtccaaactgcatgagtaattttgatgaatattgccaaattgcctttaacaggagatgtactattttccactggaaatatatatgggtgcttgtttctttacagagagggccgtagtttttaatgaactcagtttttttttttaactaaaaacaaaaccaaaacaaaaaaaacaaacaaaaaaactcccattttagagtcccttagccagaatcaggctttactttctctgtgtggagccaagttcattatttcaattcacagacagggtaactcatgggcaaataggtttttttctaaacataggtcttaagttattacattttgaaacattttttttgatttctgctaaatttctatttacatgatacattttattttaactagtacttcttaaaaatttgatatatttgaaccatcaggacagagtggtggtagcttcacatggaaagataggcttatgtttatacataccataaaatttttccacttctttactcaaaaaataagggtcccttgagggctaaggattatcacagttgacctcactgtcagaaatattaccagtttgtgagatacaaagaacaaattacccttatacatttataatttatcattttgttttattacataactaaaaactactgaaaatataaaataactcatttaggaacaagtttttagataattcatccataaagaaaattcatttggtttttcaaagaaaaagaggaaaacaagattggtgataccattaacatattttgcttttaaataacgacatgatgttggtcaaaaatttataatgttttaatatataaccccatatgaccaccagaatttggggtcttccttaggtgtagtgtcataacaataactacaataactcacatttttgtggtacttatggtttacaaagtacttccatgtacctgataataatttcagctgtcattagttgtatatgatacacactagaagatattaatctcttttcaccaaaaatgagagaaataaaaatgcattatttacttaaagtcgaaaagccagtaagtggtaaatcatagagacagaatggtggttgtcagtggacgtggggagaggggaatggggagttattgtttcatgggtacagaggttcagtttttgttttgttttgttttgtttttgagatggaatctcactctgtccctagacgggagcgcagtggcacgatctcagctcactgcaacctttgcctcccaggttcaagtgattctgctgcctcagcctcctgagtagctgggattacaggcatgcgccaccatgccagactacttttttttttttttgtatttttagtagagaaggggtttcatcatgttggtcaggttggtcttgaactcctgacctcatgatctgcccccctcggcctcccaaagtgctgggattacaggcgtgagccaccacacttggccagagtttgttttacaagataagagttctggagatggatgttggtgatagttgcacaacaatataaatgtacttaacaccactgaactgtacagttaaaatggttaggatagttttatgttacgtgtatttcaccacaagaaaaaaaaaagctagtgaatgatgagcttgtgtttgatatctgtccaaccttttctttctactcaaagcagttattatcccggtgttacagatgaagggactaaggcctagagggactgaactgacttacgtcatgtaactatcaagtggcagagttggagtttaatataatgtaagtgattttacatgcagaggcttagcataggaagtaaaaataaaaccaagggatcaattaaccactaaggactgggtaatcctgggttaatcacttcatctgtttgggcctcagtttactcagttgtaaaataaagggactgatataaatcggaggtttttttaaagtcaatgtttttgaccatgactaaaagtaagaaatgttttatattgaccagtacacagacacacacaccaccaccaccaccaccaccaccactgccagcataccttgtcctaggttgggtttcccagatgtagatcttgaaatagggatttgagtacaatttattaaggatatgctcccaggagaaactggtactggaatagaagaaatagaggaaagaggaggaaaagggtagaaatcaaccaagtgtgagatttcaggtgaagtcctggcctcagccttattccacagggagccgtagagcataaaatacttcatataatttgatcagccttgaggcaagagagtgaggctttcatacttcatcaccagtcaatcactggttacaggctaccccaataccatgtaacatcccaggcattgcagctcatggtacttgtggtagccagtcccccaaaggtggcccccagtgatcactagctcatggtattcacaccttcatatagttccctcctacactacaccattgttggtctgtgtgaccaataaaatacagcagaaatggtggtatgttgggatgagaaggagggggaaaaaagaaaaataaataaataaataaaaagaaatgatggtatgccacttctgagattaaaatgtaaaaagctgtgggatccatcttggattctctttttcttgggtcactggctctgggggaagcaaggtctcattttctgagtagtccaatgaagaggcccatgacacggactctcatgacaaggaactgaggcttctagccaacagccagcaaggaaccaaggcctgcaacaatgacttgagtttgaaggcagattttccaacctaaatcaagccttgagatgattgtagctccagctgacagcttgagtgaaatcttttgagagaccctgagccagaaccacccagttatgttgctctcagttttctgaccctcagaaaccatgtgagataataaatgtttggtgttttaagtcactaggtttttgaaaaaattgttgtgcagcaatagataaacaatatcatacactgggttgatgtggctccaatagctgaagggtagttctctgaagagcttgaggggatatcgtgtaggagagtagcacaaagacgctggggaataggcagaaccagtagaagagacctgagtgacataagcagagcatccatcatatctgctattcccccaaaagcaaacatttcatgaaacgacacttattatatgtgatatactctgatattttttattctttttattaaatgataaaagagagccctcaaattgatttcataatacactaacagatgtgacgtccagttgaaaacagtgaacataatcatctttaaggccccttatagatctaaactgctgtaattaggaggtggcacagttgttataatgataactaacatttaataagcattcactattccagaattgttctaaacacttcacatagactgtcttacgtgaagacaataaggtaggtactattactatcctcattttacagatgtggaaacttgtaaatgtcagaggccaggagggaatccaggcattctgactccaaaacctattgtcaagagtgtaggcttctatattagactgtttgggttcaaattctgattccaatggttgatcaataaatgttttcagttatgatgatgatgtacccaattattagaaattcactgatgtggataattctccctattgtcaagagtgcaggttcctgtatcagaccgtttgggtctaaatcctgatgccaatggttgatcaatgtcttttcagttatgacgatgacatactcagtgattagaaattcactaatggggataattctcacaaaaggaagtttagggccagggttatgtacatcaacattgactgaattcagcagttcaacgcattgataataagttcaatgttctgctccgcttcagccacactgacccagtcttcactttaaatgcagccactcatgcatttcaataagaaggggccctggcctaggttacataacgtctgcatgctttaacagctaaagtacacttcactgtaaccaaataggatagaaggaatttcaacatattcatttttatgtattgggttcattaaagtgcactcaaagataattctctaacaaacaaacctaactaaaaatacactagtcaccatcatgtagaaagtattcctactaaattcagtgaacattaattaacctttggatttcaaaaatgggatcaataaacacggtacaattgactaaaaggggtaaaaattatttgcagaacctggacacctggaactatcatctttttggttaaattcctctgagccaagtctctatcaattatatctttcctttcacaggaataaagtatttatcacaggtattagagtcagtgtaaaagcacaacatccttttaataaaacattctcagtaatcaaaaattcatatacctccagaatgaattatttagagctggacacatataggggaaatgtgtcaggaggatatttcagcagctgctgtgttgtaaggtgacatggaagctttagaaagagggcagaaagaaaaaaaggtttaagtcctactttagatgctattggatgattatggattataaggaacaagactggttgcaaccttgcttagaataccgctagcaggggtaagacagttttctcacgttacctattttttggaaaaaaaaatcatttctaatatgttgctaaaaagggatttacagaggatgtcatatttctcaaaccaaatatcaatctcgatgacctaaaaattaacaattcaaaataaaactttttctaattataaaagaagtcacgcttttacagaacatttaataaatgtagaaaatgtaaagaaaaaacacaaagtgatgagatattggctcacgaagtaataattatttatatgtatgtatagatacacatctccaaattgtgtgtgtgtgtgtgtgtgtgtgtgtgtgtgtgtgtgtatctccaacttggcatcacactgtaagttcattttgcaattttactttttactttttaaatttttattgaccatccccactccctcctcccaactacctttcccagcttctggtaaccatcattctactctctatctctgtgagttcaattgttttaacttttagctcccacaaataaacgcaaagtttttctttttgtgtctggcttatttcacttaacataatgacctccagttccatccatgttgtggcaaatgacagtatctcattcttttttatggctgaatagtactccattgtgtatatgtgccacattttcttcattcattcgtctgttgatggacacttaggttgtttccaaatcttggctattgtgaatagtgctgcaacaaacatgggagtgcagatatctccttagtatactgatttcctttcttttgggtatatacccagcagtgcaattgctggatcatatagtagctctatttttagtttcttaaggaacctccaaactgttctccacagtggctgtattaatttacattcccaccagtagtgtacaagggttccctttcctccatattcttgccagcatttgttattgccttcttttggataaaagccatttaaacttgggtgaaatgatacctcattgtagttttgatttgcatttctctgatgatcaatgatgttgactactttttcatatacctgtttgccatttgggtatcttcttttgagaaatatctattcaggtctttcacccatttttgatcagatcattatatttttttcctatagttgttagagctccttatatattctggctattaattccttggcagatgagtagtttagaaatattttctctcattctgtgcgatgtctcttcactttgttgattgtatcctttgttgtgcagaaacttttaaactcgatgtgatcccatttgtccatttttgctttggtggcctgtgcttgtgaggtattattcaagaaatctttgcccaatccagtgtcttagagagtttccccaatgtcttcttttagtagtttcacagttcgaggtcttagatgtgactctttaatccattttgatttgatttttttatatggtatgagagaggggtctagtttcattcttctgcatagggatatccagttttcccagcaccaattattgaagagactgtcctttccccagtgtatgttcttgggaactttgttgaaaattagttcactgtagatgtatggatttgcctctgggttctctatttggttgcattggtctatgtgtctgtttttatgccagtaccatgctgttttgtttactatagttctatagaatgatttgaagtcaggtaatgtgattcctccagttttattctttttgctcaagatagctttggctattctaagtcttttgtgattccatataaattttaggattgtttttctatctctgtgaagaatgtcattggtgctttcattgtaattttattttttttttactttaaaaatattgtgggaatttccttgtgtcaaattattctgcttcaatattaatttcatagctgtatagaattccattctatgaacatagtacttgtaattcagttatctagtcaggcaagcagaaactactctgtatatctaatgcagaaaaggactcaatgtcttccgtttagtttctcaattcatacaaaaccacatccaggccatcaccaatcattctatatgacaaatgctctttttaacaaccccacaatatcgccccttaccacaaaatcttccttcagcttaacctttcccactctaggttcccacaccacccctaatcccgcttgaagcagccctgagaaacattgcccattatctctccataccaccccaccaaaattttcactgcccgaacacttcaacactattttatgttttcttattaatgtaagaagacaggaatgtcaggcatctgagcccaaggtaagcgatcatatcccctgtggcctgcacgtatacatccagatggcctgaagtaactgaagaatcacaaaagaagtgaaaatggcctgctcctgccttaactgatgacattaccttgtgaaattccttctcctggctcagaagctcccccactgagcaccttgtgacccctgcccctgcctgcaagagaaaaaccccctttgactgtaattttccactacccacccaaatcctataaaatggccccacccctatctccttttgctgactcttttcggactcagcccacctgcacccaggtgaaataaacagccttgttgctcacaaaaaaaaaaaagtaatttgctataaggtacaaaaagtactgaaaaaacacaaaggacaaaggtgtgtatcagttagctattgctgtgtgacaaaccaccttaaacttactggttttattttaaaaacaattctgtggtcagcaatttaggctgggctcatctgggtagttctctggtctcagctgaactccttcctgctggttttgggttgactttgcagattgtggctgggctcccttacatatttgagttatcagtggagacaagagggctggctagactctgatgcacatggtttctcattctctagcaggttaatctgggattattcccatggcaatcatagggttccaaaagagtgaggagaagatggtgagtccccttgaggcctaagcttagcactatcacaacgtcattttcactgttttctattgttcaaagtaaggaataaagccagcctagattcggagagagaagaaataaattttactttttatgggaagagctgcaaagtcacattgaaaaaggtcatggaaagggagagaaagaattttggctagttttacaattcattacagtatgttttacctagagaccagaaagctctactactcctgagctgggacccacaacccatcacttaatgctgatctgtgagtgatgctaacactgctgcttttgggggtgctgctcccactgagtaggaatacaggatgccatagctttactaatgctgttaaaactgccacagatgttttggaaagaaatggctgctatagtcactgttgctgctgctattactgctggagggatttccagagacagaaaaaagaagcttatttttctcctcacctcatagtctctccaccagtgcttcccaatagcaaacctaacaggaggctaattaggaaaggaatctgaaaaatgtagtttgtgggtttctagctccctgtgatacagagagaacattgaaagtataactgggagccaagtgaaaaattgctgcacaacaatataatgttttaaactgatctcctgtgtggagacacaacataagcgtggaaagcaaagccatcagtgggacagtttctgaatccagtggacaatgatatttaatttctaggagaggtatttaagaagggatatgttctccttcagctcagtgagaaaaaggtaatacataaaacagagcacctctaagtaactttgttctagacatccaagagcagatttgtgttcattataaagggaagaacactggagttctgtgcatgaggagcaacaattatatagttgacctcaaaaattgttttcttcacattatattcccatttggttgagatctgcagattattcttaagttataatttttgtaccttgaaatacacaaaaattttacttgcattgctctatataacagtagtcacagaataactataaggtcctgaaaatactttttcaaaatgtgtttttagggtgtagcctctatacacaacattttagaaatgttttaatttttattataaaaataattcttgtataaaatcaagtgagcgcctgcagaggtagaatttcttcttaataccatacagagatggtcatgtatgtttatcctgattttttcccataaacactctaatgtattttgtgattataatcactgaagtaggatattataattctcttctctaacttagaagttaaaaattatgtataatgtgttttgccttgtagatcttgagttttaatacagttaaatgtatctactattttaaaattgcgtcattgaattctatagcatggatatactgaaatttattttatcgtttgtcttcccatgtagagtacaaactcccttaggacaagggccttgtttttttggctcacagctatatccccagtgctaagaaaagtgtctggcaaatagtaggtacttaaaaaatttgtagaatgaacgaatatatggcaaaacattattgatgaatatttagatattttccattttcactattccaataatgaattttgcaattagtattcttgcagatatattttatacatgtatttatctttctagggcaattcatagagaaggaattactgggtcaaggaacaaaaccaaattaaagaactctaacccctctcaaattcgtcccatgttcaggaagtacccaatgtgaagggaggtggcacttatatttacaaacccagtctccctagctatcacttgagtgctaccactgaaaatctcacgaatgtagtcctgttactaagtggcattggctttttaatttgttctgttttggggaagttgtctgagtctcttatgtttctacctcatgttctgatccattcaactgtcattctgttgaaatgagaacagtaccttttgtccctgctattttttgttaagcaagctatattggctacaaaactttgtgctcccaatatctttatgaactttttttctaatctggctttgttaaaatcatcccattaacccccaaggctcagggtaaatccctatggaggaaaggtaagggctcacatcattcattttatgccaatattgggctatcctcagaacagttctaatcctctgacgctaaccaaggctccttgaaccaagttttcaaagctcagttctttcccatcttcagtcgagtgacttgcaaacatacccttgacaggtctagtctcagtcctgtagatgtttctgaatcccagggtaaaatgtcatttgggctgctcaggtagggatcctagaaatactcagatatattcataaatatagaaacagatgaacaggggtatgttcaaatttcatatcagcaagttttcaagatagttcagggttcccccccttaaatcctaaaactttaatattttaatctttggggtagaaggcttcctttatagaatattcttttctgattacaaatgtaatatatgatcatttagaaatgttcagaaatagaggaaatataaaatagagaaaataaaatcacctataacctccttcccagaggcaccactgtgaaaattttatacacattttcatccaaactcttttctatatgtttttacatagttaaagtcatattgcatatacttttttgttgttgtttgcccttttcttcataacaaaacttttcctttttgactacaaatgctcttcatatacatactttctaataattgtatattagtccactgtttggatataccacatattatcagggttgtgtgttttaaaagctgtcttgcaagtttactcagaataaaaagtcagtcatattttctttcctcacccagatccactcagtcctgagtgctgtctattctatttccaaacagtttatctgtcccagaggttttaatccaagctggaacatctgggaagcttttaaaaaatactgattgttggggtcctgccacagactgattcagtcagaatccctgagggatagacctcaggtattcacatacctaaaatctccccagtggattttcatatagccagagttgagatgaagtggtcaggccagccccttctctccagccccactgccacatccctaggtggagccctccctcaactcccaattaggcaagtgcaattacctcctaactcttttcctgtttctcgtctctttctctggcaacgtctcatccttcatactccttcccaagttactttcctaaaacacaggtcagatcacatagctcccctattgagagaccttccactgctccctactgcctacactggtgagtctaatttggcctgagcaaggccttctaccaccacagcccaacctatatttccatattttttcctcctctaggtccttgtattagtttgttttattttgctgataatagaatacctgacactgagtaatttataaagaaaaggaatttatttcttacagttatggaggccgagaagtccaaggttgcagagctgtatctaataagggccttcttgctgatggggactctgcagagtcctgaggcagtgcaggacatcacatggggagggggctgagcatgctaatgtgctagcttaggtctctcttcctcttcttataaagccaccagctcccctctcattataactcattaatccattaacccattaattcattaatctataaatggattaatcccttcatgactgcagagccctcatgacccaatcacttcttagaggccacatttctcaatactgctacattggggaatacgtttcagcatgattttgatgggggcattgaaaccatagcagtgttctagtgtgccttgccacttttcttagcgagctttctgcttttgttcaaactgccttttttcacactgttcctaacctgtaatgatctccttctccaatcctcaaagaacaccatcatagtattcatacttcaaggcccatttctaatatcatatccctattcaactagtcaacaatcatctattgagggactactgtgcaccattcattagttcaacaagtttttgagttctactgtatctaggtgctaaggagataagagtgaacaaaacagacagaaatacctttccccgtagaacttacattttagtaggagacacaggaaagaaaaaaacacctaagcacattttcataaataagaaaatgttagataagtgctatgcagagaattagaacgtatagtgactgggtggctattttggtttgaaatagcctctctgaggaggtgacatttataccgagatctgaatgacaggaaggaagggaccaatcattcaaagtttagggggcaaagcattccaaagagaggatcagccaatgtgaaggctctgaggtggaatgaagcctacttgtttgaagaacagaaagaaggccagagcagctgaagcacagatccaaagggggagtagtggcagagagagtcagagccagcttatatacgcttttgtggttgttgttgttttgtttgttttgagacagagtctcactctgtcgcccaagctggagtgcaatggtgtgatcttggctcactgcaacctctgcctcctgggttcaagcaattctcctgcctcagcctcctgagtagctaggattataggcacatgcccccacacccagctaatttttgtatttttagtagagacagggttttgccatgtcggccaggctcatctcgaactcctgagctcaagaaatccacccgcctcagcctcccaaaatgctgggattacaggcgtgagccaccacgcctggcctcatatatgctttctaagtcagggcaaagagttaaaatttgattccaagtgcaacgatgagaagccactagataattttaagccatagagtgatatgaaatggtttgtgtttgaacaagatcactctggttgttgtgtgaacaagagatagagggggtaacagtaggaggagggaccaggtagatgctttggtagcagtccagttttccttgaactacttgctgaatttgaagcaaataaaaagcaaacacttctcttactcttaggcaaaagattaaaattcttaatgtcacctaaaaagacctggatgggctggcctctctccagccttctctataccttcattgcctcctgctattgagccttgctgaccttccttcagctccgcaacctacatcattccttcaggccacaggacacttggacttgctgtggttacatattatttctgtgtgttataaaatacacataacatgcaatttaccactttacctattttaaggtgtacaattcaacattaagtacattcccactgttgcacaaccatcaccactatctagctccaggacttattcgtcaccacaagaataaaccccatatccattaaacggtgactctccattagggttagcccttggcaaccactaatctgcctatggatttgactattacggacagttcatataaatagaattatacatatgcatccttctgcatctggctttcgctcagcataatgttttcaaggttcatccaagttgtatcatgcatcagtacttcatctctttttatggctgaataatattccctagtgtagatatgccacaaaatagatttcattaatctacttgtcactggacatttatttaggttgttttcatattttggctattgtaaatggtgctactgtgagttgcttggtgatatggcagctgtgattatatattgatgcattatagatcagtgaatcttagacacgtgatagtttcctacagctgctgtaacaaagtaccacaagctgggtggctttaaaaaaaacagaaatgtattatctcacagttctagaggctaggagtctgacatcaaagtgtcagcagggccatcctctctctgagactctgggtagaatccttccttgcctcctcctagcttctggaggtgaccatcaatccttggcagtctttggcttgtagctgcatcactctgatctctacttctgttgtcacaatggccttctccctgtgtgtctttgtgttttcctatggccctctccctgtgtctcttcttttaaggatatgagcccttaaaagtgcttggattatgggcccccactactccagtatgaccttgtcttaattatatttgcaacaaccctatttccaaataagatcacattctgaggtactggggttaggacttcagccgcacctagcctggacttcaatatatcttttgggaggacacaattcaatccataatacatgacagacattactgtgcatctgactcccctggagatcttgttaacatgggcttggagtggggcttgaggttctgcatgttcaaacagctcttccagtggatgtcaatgctgccagctcagggttagtgtgactaatatgttctggtttgcgcaaggccttcctggttttagcaatgaaaatcctgaatgcagggaaacccctcagtcctgggcaaactgggatggcttgtcaccctatatatatgtcatgggccacaattggagagcaaggatctagctacaagctatgttaatttatctactaattacattactgaatattcatatttatctttatatttaaatggtttatttttgctagaacagtccaagttttcaagaatctggacctaagagatattccaaaaatgctccaaactgtgagacggtgagttagcttaaactgatgggtgtcttctgtgaatgtcatatattaactcaccaaattatctatgatgcttagcagtgtcactgttgggctgaacattgagatttctgacctctttacaaaataattatacatggccaagatcttttgatgctaaggatacccactgggcttgaagtcttcagtatcctttccctgctgctgcagcagttggaatcagcctggagtctgtaagaatgaaagagaaagctcctctctgaagttgggtttaagttcattgcagtatggggcaatgcccctcaactcttgcttaatattcagaccacctgaagagcttctaaaacgcggagctttcaccccacaccaaatgactccaaatagctgggattgggcacaggcattcataattgttttaaaacaccaggtgatgcaaatgagcacccagcatcgagaatcagtgtgccaagacccctttataacagacaccttgctcaacctgtcccttctttcacctgcacctatattccacccttgtatgcccacatacctttttgttatagttgacaatttccttaaacaggttctcctcttcctcatatttttgtcctgttcatacagttaccttattgacctgagaccacatataactggatagaggtaataattactcctgtaacaactgaccttagcaggcttttcccaagccttattgactctgtttttcactctttcacaaatatgtatccttaacatcatcatccacgattgagttaacctgtgatagtgttgctgtttttgactagtctcttagcaatcaagctaaatctcccactgaatctgtgtgttcctctacaaaccatatctgggtggaatgtacgtttttattgtgatataattaatatatcataaaagtcatcctcttaaagtatacaactcagtggtttttagtaattcacagtattgtgcaaccatcatcactatgtaattctagaacattctcattactctaaaaagaagccgcttacccattaaaagtcacctcattcctgcctcccactcgctgcaaccactaatctcttttgtctctatggatttgtctattttggatatttcctatacatgaatcattcaatatgtggtcttttgtgtctggcgtctttcgcttagcatattttcaaggttcatccacgttgcagcatttaccagtagtacttcattcttttttgtggccgaataattttccgttgtatggaggcaccgaattttggtcatccactcatcagctgacggatatttgagttgtttccaatttttggctattgtgaataatgccgctataaacattcatgtatatggttttgtgtgggcatatattttcatttctcttgggtaaatacccaggaatggagttgctagatcatatgcaaactctgttcaactttttgaggaactccaaattggttgtgaacattattttttgacctcaatgcagctttcctttacaggagggaggtggactgtacttgttagcgcgctgcaaatgattctcaggcatattaaacatttttctgtattctgttaaacattgtatgcgcagcaagaatgacgcctcatacagacctttcttgtcatttcgttttattatttcaaaatgtaagacaaatctgaaaaatggaggagcctgcagatacctgtggtggcgaggatttggggtctgtctgagctccggcgttcctgcccatccctccagctgtatctctggccacctgtctgttcctggcacaaacaaggcctgctggttgccaaggacatgactacggggccatttccatgtgagaaggccctggggggtgtcaaaatgcagaaacgtgactgatgggcagcggggcacccataaacttcccatagccaggtgcaggcatacctgcaaatgtaacgcccaactgtgtacaaagcagaaatctaaatgccagggcggactgggagaggttcccgtgacctctgacccggcctctaaattctcccattccctccccactgtcctgccgcgccccgtgtcgcctcgcctggcctcgcctggcctcgcctccctcctccgctgggggtctaagcctgcgcagtattgcgaacgcgggcggcgtttcccgcatgcgcagtcactgcccggcccggctttttcagtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaacc
